(12) United States Patent
Tipton et al.

(10) Patent No.: US 10,513,558 B2
(45) Date of Patent: Dec. 24, 2019

(54) ANTI-PD1 ANTIBODIES, ACTIVATABLE ANTI-PD1 ANTIBODIES, AND METHODS OF USE THEREOF

(71) Applicant: CytomX Therapeutics, Inc., South San Francisco, CA (US)

(72) Inventors: Kimberly Ann Tipton, South San Francisco, CA (US); James William West, South San Francisco, CA (US); Chanty Mariategue Chan, South San Francisco, CA (US)

(73) Assignee: CytomX Therapeutics, Inc.CA (US)

( * ) Notice: Subject to any disclaimer, the term of this patent is extended or adjusted under 35 U.S.C. 154(b) by 494 days.

(21) Appl. No.: 15/209,385

(22) Filed: Jul. 13, 2016

(65) Prior Publication Data
US 2017/0044259 A1 Feb. 16, 2017

Related U.S. Application Data

(60) Provisional application No. 62/191,902, filed on Jul. 13, 2015, provisional application No. 62/205,825, filed on Aug. 17, 2015, provisional application No. 62/295,314, filed on Feb. 15, 2016, provisional application No. 62/323,543, filed on Apr. 15, 2016, provisional application No. 62/333,629, filed on May 9, 2016.

(51) Int. Cl.
| | | |
|---|---|---|
| *C07K 16/28* | (2006.01) | |
| *A61K 39/395* | (2006.01) | |
| *C07K 16/30* | (2006.01) | |
| *A61K 47/68* | (2017.01) | |
| *A61K 39/00* | (2006.01) | |

(52) U.S. Cl.
CPC ...... *C07K 16/2818* (2013.01); *A61K 39/3955* (2013.01); *A61K 47/6849* (2017.08); *C07K 16/30* (2013.01); *C07K 16/303* (2013.01); *C07K 16/3015* (2013.01); *C07K 16/3023* (2013.01); *C07K 16/3038* (2013.01); *C07K 16/3046* (2013.01); *C07K 16/3053* (2013.01); *C07K 16/3069* (2013.01); *A61K 2039/505* (2013.01); *A61K 2039/507* (2013.01); *A61K 2039/545* (2013.01); *C07K 2317/24* (2013.01); *C07K 2317/54* (2013.01); *C07K 2317/55* (2013.01); *C07K 2317/56* (2013.01); *C07K 2317/565* (2013.01); *C07K 2317/569* (2013.01); *C07K 2317/622* (2013.01); *C07K 2317/92* (2013.01); *C07K 2319/50* (2013.01)

(58) Field of Classification Search
None
See application file for complete search history.

(56) References Cited

U.S. PATENT DOCUMENTS

| | | | |
|---|---|---|---|
| 3,773,919 | A | 11/1973 | Boswell et al. |
| 4,485,045 | A | 11/1984 | Regen |
| 4,544,545 | A | 10/1985 | Ryan et al. |
| 5,013,556 | A | 5/1991 | Woodle et al. |
| 5,030,719 | A | 7/1991 | Umemoto et al. |
| 5,151,510 | A | 9/1992 | Stec et al. |
| 6,808,710 | B1 | 10/2004 | Wood et al. |
| 7,029,674 | B2 | 4/2006 | Carreno et al. |
| 7,101,550 | B2 | 9/2006 | Wood et al. |
| 7,105,328 | B2 | 9/2006 | Wood et al. |
| 7,332,582 | B2 | 2/2008 | Hardy et al. |
| 7,432,351 | B1 | 10/2008 | Chen |
| 7,449,300 | B2 | 11/2008 | Chen |
| 7,465,790 | B2 | 12/2008 | Waldmann et al. |
| 7,488,802 | B2 | 2/2009 | Collins et al. |
| 7,521,051 | B2 | 4/2009 | Collins et al. |
| 7,563,869 | B2 | 7/2009 | Honjo et al. |
| 7,595,048 | B2 * | 9/2009 | Honjo ............. A61K 31/7088 424/142.1 |
| 7,638,492 | B2 | 12/2009 | Wood et al. |
| 7,666,817 | B2 | 2/2010 | Daugherty et al. |
| 7,700,301 | B2 | 4/2010 | Wood et al. |
| 7,858,746 | B2 | 12/2010 | Honjo et al. |
| 7,892,540 | B2 | 2/2011 | Chen et al. |
| 7,998,479 | B2 | 8/2011 | Honjo et al. |
| 8,008,449 | B2 | 8/2011 | Korman et al. |
| 8,039,589 | B1 | 10/2011 | Chen |
| 8,053,558 | B2 | 11/2011 | Pardoll et al. |
| 8,088,905 | B2 | 1/2012 | Collins et al. |
| 8,114,845 | B2 * | 2/2012 | Langermann ........ A61K 31/675 514/21.2 |

(Continued)

FOREIGN PATENT DOCUMENTS

| | | |
|---|---|---|
| CN | 103059138 B | 4/2013 |
| CN | 103242448 A | 8/2013 |

(Continued)

OTHER PUBLICATIONS

Van Regenmortel MHV. Front. Immunol. (2018) vol. 8, Article 2009 (11 pages).*
Yokosuka et al. J. Exp. Med. (2012) 209: 1201-1217.*
Matsumoto et al. Journal of Gastroenterology and Hepatology (2014) 29: 110-115.*
Formulary (2018), Table of Contents only, 3 pages.*
Donaldson et al., Design and development of masked therapeutic antibodies to limit off-target effects: Application to anti-EGFR antibodies. Cancer Biology & Therapy, vol. 8(22): 2147-2152 (2009).

(Continued)

*Primary Examiner* — Ilia I Ouspenski
(74) *Attorney, Agent, or Firm* — Fish & Richardson P.C.

(57) ABSTRACT

The invention relates generally to antibodies that specifically bind programmed cell death protein 1 (PD-1), activatable antibodies that specifically bind to PD-1 and methods of making and using these anti-PD-1 antibodies and anti-PD-1 activatable antibodies in a variety of therapeutic, diagnostic and prophylactic indications.

77 Claims, 37 Drawing Sheets

Specification includes a Sequence Listing.

(56) References Cited

U.S. PATENT DOCUMENTS

| | | |
|---|---|---|
| 8,168,757 B2 | 5/2012 | Finnefrock et al. |
| 8,273,864 B2 | 9/2012 | Chen |
| 8,287,856 B2 | 10/2012 | Li et al. |
| 8,354,509 B2 | 1/2013 | Carven et al. |
| 8,460,927 B2 | 6/2013 | Chen |
| 8,513,390 B2 * | 8/2013 | Stagliano ............ A61K 47/6849 530/387.3 |
| 8,518,404 B2 | 8/2013 | Daugherty et al. |
| 8,529,898 B2 | 9/2013 | Daugherty et al. |
| 8,541,203 B2 | 9/2013 | Daugherty et al. |
| 8,552,154 B2 | 10/2013 | Freeman et al. |
| 8,563,269 B2 | 10/2013 | Stagliano et al. |
| 8,580,247 B2 | 11/2013 | Li et al. |
| 8,617,546 B2 | 11/2013 | Li et al. |
| 8,686,119 B2 | 4/2014 | Rotem-Yehudar et al. |
| 8,709,416 B2 | 4/2014 | Langermann et al. |
| 8,728,474 B2 | 5/2014 | Honjo et al. |
| 8,735,553 B1 | 5/2014 | Li et al. |
| 8,747,833 B2 | 6/2014 | Chen et al. |
| 8,747,847 B2 | 6/2014 | Rotem-Yehudar et al. |
| 8,779,105 B2 | 7/2014 | Korman et al. |
| 8,809,504 B2 | 8/2014 | Lauermann |
| 8,900,587 B2 | 12/2014 | Carven et al. |
| 8,927,697 B2 | 1/2015 | Davis et al. |
| 8,951,518 B2 | 2/2015 | Honjo et al. |
| 8,952,136 B2 | 2/2015 | Carven et al. |
| 8,956,619 B2 | 2/2015 | Ostrand-Rosenberg |
| 8,981,063 B2 | 3/2015 | Chen |
| 8,992,927 B1 | 3/2015 | Clube |
| 8,993,524 B2 | 3/2015 | Bedi et al. |
| 8,993,731 B2 | 3/2015 | Tyson |
| 9,062,112 B2 | 6/2015 | Chen |
| 9,067,998 B1 | 6/2015 | Clube |
| 9,067,999 B1 | 6/2015 | Honjo et al. |
| 9,073,994 B2 | 7/2015 | Honjo et al. |
| 9,084,776 B2 | 7/2015 | Korman et al. |
| 9,095,628 B2 | 8/2015 | Govindan et al. |
| 9,102,727 B2 | 8/2015 | Freeman et al. |
| 9,107,728 B2 | 8/2015 | Breazzano et al. |
| 9,163,087 B2 | 10/2015 | Kuchroo et al. |
| 9,169,321 B2 | 10/2015 | Daugherty et al. |
| 9,181,342 B2 | 11/2015 | Davis |
| 9,187,562 B1 | 11/2015 | Clube |
| 9,205,148 B2 | 12/2015 | Langermann et al. |
| 9,212,224 B2 | 12/2015 | Cogswell et al. |
| 9,217,034 B2 | 12/2015 | Li et al. |
| 9,220,776 B2 | 12/2015 | Sharma et al. |
| 9,243,052 B2 | 1/2016 | Olive et al. |
| 9,283,286 B2 | 3/2016 | Govindan et al. |
| 9,358,289 B2 | 6/2016 | Korman et al. |
| 9,382,329 B2 | 7/2016 | Chang et al. |
| 9,387,247 B2 | 7/2016 | Korman et al. |
| 9,453,078 B2 | 9/2016 | Stagliano et al. |
| 9,486,536 B2 | 11/2016 | Govindan et al. |
| 9,492,539 B2 | 11/2016 | Korman et al. |
| 9,492,540 B2 | 11/2016 | Korman et al. |
| 9,499,603 B2 | 11/2016 | Tyson |
| 9,546,206 B2 | 1/2017 | Ring et al. |
| 9,598,491 B2 * | 3/2017 | Ahmed ............... A61K 31/7105 |
| 9,637,546 B2 | 5/2017 | Olive et al. |
| 9,650,429 B2 | 5/2017 | Ostrand-Rosenberg |
| 9,670,286 B2 | 6/2017 | Chang et al. |
| 9,676,853 B2 * | 6/2017 | Zhou ................. C07K 16/2818 |
| 9,683,043 B2 | 6/2017 | Davis et al. |
| 9,683,048 B2 | 6/2017 | Freeman et al. |
| 9,701,749 B2 * | 7/2017 | Shibayama .......... A61K 39/395 |
| 9,724,390 B2 | 8/2017 | Gurney |
| 9,724,413 B2 | 8/2017 | Maecker et al. |
| 9,765,147 B2 | 9/2017 | Wong et al. |
| 9,783,589 B2 | 10/2017 | Grewal et al. |
| 9,783,609 B2 | 10/2017 | Honjo et al. |
| 9,803,015 B2 | 10/2017 | Chen et al. |
| 9,815,897 B2 | 11/2017 | King et al. |
| 9,815,898 B2 | 11/2017 | Freeman et al. |
| 9,834,605 B2 | 12/2017 | Carven et al. |
| 9,834,606 B2 | 12/2017 | Li et al. |
| 9,834,607 B2 | 12/2017 | Kuchroo et al. |
| 9,839,687 B2 | 12/2017 | Zhao |
| 9,856,320 B2 | 1/2018 | Cogswell et al. |
| 9,907,849 B2 | 3/2018 | Petit et al. |
| 9,988,450 B2 | 6/2018 | Li et al. |
| 10,011,656 B2 | 7/2018 | Freeman et al. |
| 10,131,712 B2 | 11/2018 | Rossi et al. |
| 2004/0109855 A1 | 6/2004 | Waldmann et al. |
| 2009/0304719 A1 | 12/2009 | Daugherty et al. |
| 2010/0040614 A1 | 2/2010 | Ahmed et al. |
| 2010/0189651 A1 | 7/2010 | Stagliano et al. |
| 2011/0171215 A1 | 7/2011 | Davis et al. |
| 2011/0177088 A1 | 7/2011 | Olive et al. |
| 2011/0229461 A1 | 9/2011 | Tyson |
| 2012/0149061 A1 | 6/2012 | Stagliano et al. |
| 2012/0237512 A1 | 9/2012 | Daugherty et al. |
| 2012/0237977 A1 | 9/2012 | Daugherty et al. |
| 2012/0244154 A1 | 9/2012 | Daugherty et al. |
| 2012/0251537 A1 | 10/2012 | Ahmed et al. |
| 2013/0071403 A1 | 3/2013 | Rolland et al. |
| 2013/0309230 A1 | 11/2013 | Stagliano et al. |
| 2013/0309250 A1 | 11/2013 | Cogswell et al. |
| 2014/0024810 A1 | 1/2014 | Stagliano et al. |
| 2014/0045195 A1 | 2/2014 | Daugherty et al. |
| 2014/0271677 A1 | 9/2014 | Palese et al. |
| 2014/0302070 A1 | 10/2014 | Chen et al. |
| 2014/0335093 A1 | 11/2014 | Olive |
| 2014/0356363 A1 | 12/2014 | Zhou et al. |
| 2015/0003579 A1 | 1/2015 | Kim et al. |
| 2015/0118222 A1 | 4/2015 | Levy et al. |
| 2015/0152180 A1 | 6/2015 | Davis et al. |
| 2015/0165021 A1 | 6/2015 | Mashal et al. |
| 2015/0166661 A1 | 6/2015 | Chen et al. |
| 2015/0183881 A1 | 7/2015 | Bedi et al. |
| 2015/0190506 A1 | 7/2015 | Cheung et al. |
| 2015/0202291 A1 | 7/2015 | Bosch et al. |
| 2015/0203579 A1 | 7/2015 | Papadopoulos et al. |
| 2015/0210769 A1 | 7/2015 | Freeman et al. |
| 2015/0210772 A1 | 7/2015 | Kim |
| 2015/0232555 A1 | 8/2015 | Carven et al. |
| 2015/0239972 A1 | 8/2015 | Ahmed et al. |
| 2015/0265705 A1 | 9/2015 | Li et al. |
| 2015/0322119 A1 | 11/2015 | Engelhardt et al. |
| 2015/0344577 A1 | 11/2015 | Engelhardt et al. |
| 2015/0352206 A1 | 12/2015 | Gajewski et al. |
| 2015/0366174 A1 | 12/2015 | Burova et al. |
| 2016/0009807 A1 | 1/2016 | Govindappa et al. |
| 2016/0017051 A1 | 1/2016 | Clube |
| 2016/0031990 A1 | 2/2016 | Steele et al. |
| 2016/0067336 A1 | 3/2016 | Fandi et al. |
| 2016/0075783 A1 | 3/2016 | King et al. |
| 2016/0101128 A1 | 4/2016 | Wang et al. |
| 2016/0106835 A1 | 4/2016 | Hoos et al. |
| 2016/0122425 A1 | 5/2016 | Daugherty et al. |
| 2016/0122829 A1 | 5/2016 | Hammerman |
| 2016/0130348 A1 | 5/2016 | Langermann et al. |
| 2016/0145355 A1 | 5/2016 | Saha et al. |
| 2016/0151515 A1 | 6/2016 | Joubert et al. |
| 2016/0159905 A1 | 6/2016 | Abdiche et al. |
| 2016/0166685 A1 | 6/2016 | Cheung et al. |
| 2016/0176962 A1 | 6/2016 | Murriel et al. |
| 2016/0193239 A1 | 7/2016 | Baylin et al. |
| 2016/0193334 A1 | 7/2016 | Strack et al. |
| 2016/0194399 A1 * | 7/2016 | Irving ................. A61K 39/395 424/135.1 |
| 2016/0199487 A1 | 7/2016 | Gu et al. |
| 2016/0206754 A1 | 7/2016 | Chang et al. |
| 2016/0215061 A1 | 7/2016 | Shaheen et al. |
| 2016/0222113 A1 | 8/2016 | Buchanan et al. |
| 2016/0222116 A1 | 8/2016 | Korman et al. |
| 2016/0222121 A1 | 8/2016 | Johnson et al. |
| 2016/0228546 A1 | 8/2016 | Stagliano et al. |
| 2016/0251436 A1 | 9/2016 | Amirina et al. |
| 2016/0251437 A1 | 9/2016 | Dong et al. |
| 2016/0264667 A1 | 9/2016 | Chen et al. |
| 2016/0271239 A1 | 9/2016 | Foy et al. |
| 2016/0272708 A1 | 9/2016 | Chen |
| 2016/0289315 A1 | 10/2016 | Mirza et al. |

(56) References Cited

U.S. PATENT DOCUMENTS

| | | |
|---|---|---|
| 2016/0289341 A1 | 10/2016 | Wu |
| 2016/0303231 A1 | 10/2016 | Iannone et al. |
| 2016/0304607 A1 | 10/2016 | Sadineni et al. |
| 2016/0304969 A1 | 10/2016 | Ayers et al. |
| 2016/0305947 A1 | 10/2016 | Pierce et al. |
| 2016/0311902 A1 | 10/2016 | Morsey et al. |
| 2016/0311903 A1* | 10/2016 | West .................. A61K 49/0021 |
| 2016/0312295 A1 | 10/2016 | Ayers et al. |
| 2016/0312297 A1 | 10/2016 | Ayers et al. |
| 2016/0339090 A1 | 11/2016 | Hacohen et al. |
| 2016/0340428 A1 | 11/2016 | Yang |
| 2016/0340430 A1 | 11/2016 | Bedi et al. |
| 2016/0347836 A1 | 12/2016 | Grosso |
| 2016/0362460 A1 | 12/2016 | Olwill et al. |
| 2016/0362489 A1 | 12/2016 | Yang |
| 2016/0376367 A1 | 12/2016 | Yuan et al. |
| 2017/0007693 A1 | 1/2017 | Weiner et al. |
| 2017/0007715 A1 | 1/2017 | Andreev et al. |
| 2017/0008971 A1 | 1/2017 | Dennis et al. |
| 2017/0015758 A1 | 1/2017 | Hammond et al. |
| 2017/0020931 A1 | 1/2017 | Zhou et al. |
| 2017/0021019 A1 | 1/2017 | Zibelman et al. |
| 2017/0029508 A1 | 2/2017 | Eisenbach-Schwartz et al. |
| 2017/0037125 A1 | 2/2017 | Leopold et al. |
| 2017/0042995 A1 | 2/2017 | Ali et al. |
| 2017/0044260 A1 | 2/2017 | Baruah et al. |
| 2017/0051060 A1 | 2/2017 | Honjo et al. |
| 2017/0056391 A1 | 3/2017 | Li |
| 2017/0081397 A1 | 3/2017 | Stagliano et al. |
| 2017/0081409 A1 | 3/2017 | Dijk et al. |
| 2017/0088615 A1 | 3/2017 | Korman et al. |
| 2017/0088618 A1 | 3/2017 | Bennett et al. |
| 2017/0088626 A1 | 3/2017 | Jure-Kunkel et al. |
| 2017/0089914 A1 | 3/2017 | Loo et al. |
| 2017/0112925 A1 | 4/2017 | Junttila |
| 2017/0114137 A1 | 4/2017 | Li |
| 2017/0121409 A1 | 5/2017 | Verona et al. |
| 2017/0137517 A1 | 5/2017 | Bowman et al. |
| 2017/0137520 A1 | 5/2017 | Punnonen et al. |
| 2017/0143780 A1 | 5/2017 | Zitvogel et al. |
| 2017/0146520 A1 | 5/2017 | Ahmed et al. |
| 2017/0157188 A1 | 6/2017 | Silvestre et al. |
| 2017/0158764 A1 | 6/2017 | Mizuno et al. |
| 2017/0158776 A1 | 6/2017 | Feltquate et al. |
| 2017/0165230 A1 | 6/2017 | Rudd et al. |
| 2017/0166637 A1 | 6/2017 | Ben-Moshe et al. |
| 2017/0166642 A1 | 6/2017 | Pantaleo et al. |
| 2017/0174773 A1 | 6/2017 | Davis et al. |
| 2017/0174774 A1 | 6/2017 | Coric et al. |
| 2017/0198039 A1 | 7/2017 | Wong |
| 2017/0204194 A1 | 7/2017 | Chen et al. |
| 2017/0226210 A1 | 8/2017 | Pantaleo et al. |
| 2017/0226219 A1 | 8/2017 | Chang et al. |
| 2017/0240644 A1 | 8/2017 | Zhou et al. |
| 2017/0247454 A1 | 8/2017 | Benz et al. |
| 2017/0247455 A1 | 8/2017 | Jure-Kunkel et al. |
| 2017/0260271 A1 | 9/2017 | Igawa et al. |
| 2017/0266270 A1 | 9/2017 | Foy et al. |
| 2017/0267756 A1 | 9/2017 | Riddell et al. |
| 2017/0267762 A1 | 9/2017 | Qui et al. |
| 2017/0290808 A1 | 10/2017 | Charo et al. |
| 2017/0290913 A1 | 10/2017 | Cheung et al. |
| 2017/0306050 A1 | 10/2017 | Degenhardt et al. |
| 2017/0313776 A1 | 11/2017 | Zhou et al. |
| 2017/0320949 A1 | 11/2017 | Shibayama et al. |
| 2017/0327567 A1 | 11/2017 | Skokos et al. |
| 2017/0334995 A1 | 11/2017 | Zettl et al. |
| 2017/0355768 A1 | 12/2017 | Robbins et al. |
| 2017/0362321 A1 | 12/2017 | Campbell et al. |
| 2017/0367997 A1 | 12/2017 | Kawakami et al. |
| 2018/0000851 A1 | 1/2018 | Krieg |
| 2018/0015161 A1 | 1/2018 | Weiner et al. |
| 2018/0016555 A1 | 1/2018 | Borges et al. |
| 2018/0021407 A1 | 1/2018 | Gurney |
| 2018/0021431 A1 | 1/2018 | Maecker et al. |
| 2018/0051082 A1 | 2/2018 | King et al. |
| 2018/0051083 A1 | 2/2018 | Kuchroo et al. |
| 2018/0051085 A1 | 2/2018 | Chang et al. |
| 2018/0111996 A1 | 4/2018 | Carven et al. |
| 2018/0118846 A1 | 5/2018 | Chang et al. |
| 2018/0148513 A1 | 5/2018 | Afar et al. |
| 2018/0148790 A1 | 5/2018 | Ayers et al. |
| 2018/0155430 A1 | 6/2018 | Ahmed et al. |
| 2018/0179281 A1 | 6/2018 | Chen et al. |
| 2018/0185483 A1 | 7/2018 | Petit et al. |
| 2018/0185668 A1 | 7/2018 | Papadopoulos et al. |
| 2018/0201684 A1 | 7/2018 | Chen |
| 2018/0206462 A1 | 7/2018 | Burova et al. |
| 2018/0251551 A1 | 9/2018 | Li et al. |
| 2018/0251554 A1 | 9/2018 | Morsey et al. |
| 2018/0282413 A1 | 10/2018 | Cogswell et al. |

FOREIGN PATENT DOCUMENTS

| | | |
|---|---|---|
| CN | 103721255 A | 4/2014 |
| CN | 104479020 A | 4/2015 |
| CN | 104560884 A | 4/2015 |
| CN | 104711292 A | 6/2015 |
| CN | 105085680 A | 11/2015 |
| CN | 105194668 A | 12/2015 |
| CN | 105566496 A | 5/2016 |
| CN | 105622753 A | 6/2016 |
| CN | 105669864 A | 6/2016 |
| CN | 106336460 A | 1/2017 |
| CN | 106432494 A | 2/2017 |
| CN | 106928361 A | 7/2017 |
| CN | 107840887 A | 3/2018 |
| CN | 108314734 A | 7/2018 |
| CN | 106967172 B | 1/2019 |
| EP | 1324771 A2 | 7/2003 |
| EP | 1523503 A1 | 4/2005 |
| EP | 1210424 B1 | 2/2007 |
| EP | 1537878 B1 | 9/2010 |
| EP | 1576014 B1 | 6/2011 |
| EP | 2360254 A1 | 8/2011 |
| EP | 1297135 B1 | 1/2013 |
| EP | 2161336 B1 | 7/2013 |
| EP | 2172219 B1 | 9/2013 |
| EP | 2170959 B1 | 10/2013 |
| EP | 1210428 B1 | 3/2015 |
| EP | 2350129 B1 | 6/2015 |
| EP | 2079760 B1 | 4/2016 |
| EP | 2535354 B1 | 1/2017 |
| EP | 1234031 B1 | 3/2017 |
| EP | 2133365 B1 | 5/2017 |
| EP | 2542590 B1 | 5/2017 |
| EP | 3287144 A1 | 2/2018 |
| EP | 1810026 B1 | 4/2018 |
| IN | 201617012873 | 8/2016 |
| IN | 201717019999 | 11/2017 |
| IN | 201817003338 | 5/2018 |
| TW | 201711699 A1 | 4/2017 |
| TW | 201825516 A | 7/2018 |
| WO | WO 2001/91798 A2 | 12/2001 |
| WO | WO 2002/030460 A2 | 4/2002 |
| WO | WO 2004/009638 A1 | 1/2004 |
| WO | WO 2006/121168 A1 | 11/2006 |
| WO | WO 2007/105027 A1 | 9/2007 |
| WO | WO 2008/156712 A1 | 12/2008 |
| WO | WO 2009/025846 A2 | 2/2009 |
| WO | WO 2010/081173 A2 | 7/2010 |
| WO | WO 2010/129609 A2 | 11/2010 |
| WO | WO 2012/018538 A2 | 2/2012 |
| WO | WO 2012/145493 A1 | 10/2012 |
| WO | WO 2013/192546 A1 | 12/2013 |
| WO | WO 2014/026136 A2 | 2/2014 |
| WO | WO 2014/059251 A1 | 4/2014 |
| WO | WO 2014/074852 A1 | 5/2014 |
| WO | WO 2014/161509 A1 | 10/2014 |
| WO | WO 2014/179664 A2 | 11/2014 |
| WO | WO 2014/194293 A1 | 12/2014 |
| WO | WO 2014/206107 A1 | 12/2014 |
| WO | WO 2015/038538 A1 | 3/2015 |
| WO | WO 2015/058573 A1 | 4/2015 |

(56) References Cited

FOREIGN PATENT DOCUMENTS

| | | |
|---|---|---|
| WO | WO 2015/092393 A2 | 6/2015 |
| WO | WO 2015/095404 A2 | 6/2015 |
| WO | WO 2015/195163 A1 | 12/2015 |
| WO | WO 2015/200828 A1 | 12/2015 |
| WO | WO 2016/011160 A1 | 1/2016 |
| WO | WO 2016/014688 A2 | 1/2016 |
| WO | WO 2016/014799 A1 | 1/2016 |
| WO | WO 2016/015685 A1 | 2/2016 |
| WO | WO 2016/032927 A1 | 3/2016 |
| WO | WO 2016/059602 A2 | 4/2016 |
| WO | WO 2016/062722 A1 | 4/2016 |
| WO | WO 2016/071701 A1 | 5/2016 |
| WO | WO 2016/075174 A1 | 5/2016 |
| WO | WO 2016/077397 A2 | 5/2016 |
| WO | WO 2016/106159 A1 | 6/2016 |
| WO | WO 2016/110593 A1 | 7/2016 |
| WO | WO 2016/115274 A1 | 7/2016 |
| WO | WO 2016/128912 A1 | 8/2016 |
| WO | WO 2016/137850 A1 | 9/2016 |
| WO | WO 2016/140717 A1 | 9/2016 |
| WO | WO 2016/141209 A1 | 9/2016 |
| WO | WO 2016/144673 A1 | 9/2016 |
| WO | WO 2016/146329 A1 | 9/2016 |
| WO | WO 2016/153839 A1 | 9/2016 |
| WO | WO 2016/154412 A1 | 9/2016 |
| WO | WO 2016/160966 A1 | 10/2016 |
| WO | WO 2016/160968 A1 | 10/2016 |
| WO | WO 2016/160970 A1 | 10/2016 |
| WO | WO 2016/160972 A1 | 10/2016 |
| WO | WO 2016/160973 A1 | 10/2016 |
| WO | WO 2016/168143 A1 | 10/2016 |
| WO | WO 2016/170039 A1 | 10/2016 |
| WO | WO 2016/172249 A1 | 10/2016 |
| WO | WO 2016/175275 A1 | 11/2016 |
| WO | WO 2016/181348 A1 | 11/2016 |
| WO | WO 2016/183469 A1 | 11/2016 |
| WO | WO 2016/191751 A1 | 12/2016 |
| WO | WO 2016/205320 A1 | 12/2016 |
| WO | WO 2016/210129 A1 | 12/2016 |
| WO | WO 2017/004192 A1 | 1/2017 |
| WO | WO 2017/007985 A1 | 1/2017 |
| WO | WO 2017/011666 A1 | 1/2017 |
| WO | WO 2017/016497 A1 | 2/2017 |
| WO | WO 2017/017623 A1 | 2/2017 |
| WO | WO 2017/017624 A1 | 2/2017 |
| WO | WO 2017/019846 A1 | 2/2017 |
| WO | WO 2017/019896 A1 | 2/2017 |
| WO | WO 2017/020858 A1 | 2/2017 |
| WO | WO 2017/024515 A1 | 2/2017 |
| WO | WO 2017/025051 A1 | 2/2017 |
| WO | WO 2017/025498 A1 | 2/2017 |
| WO | WO 2017/040960 A1 | 3/2017 |
| WO | WO 2017/055404 A1 | 4/2017 |
| WO | WO 2017/055547 A1 | 4/2017 |
| WO | WO 2017/059387 A1 | 4/2017 |
| WO | WO 2017/062797 A1 | 4/2017 |
| WO | WO 2017/066557 A1 | 4/2017 |
| WO | WO 2017/066561 A2 | 4/2017 |
| WO | WO 2017/070135 A1 | 4/2017 |
| WO | WO 2017/070137 A1 | 4/2017 |
| WO | WO 2017/071625 A1 | 5/2017 |
| WO | WO 2017/079080 A1 | 5/2017 |
| WO | WO 2017/079303 A1 | 5/2017 |
| WO | WO 2017/087599 A1 | 5/2017 |
| WO | WO 2017/087870 A1 | 5/2017 |
| WO | WO 2017/058115 A1 | 6/2017 |
| WO | WO 2017/096026 A1 | 6/2017 |
| WO | WO 2017/106061 A1 | 6/2017 |
| WO | WO 2017/106656 A1 | 6/2017 |
| WO | WO 2017/120604 A1 | 7/2017 |
| WO | WO 2017/125815 A2 | 7/2017 |
| WO | WO 2017/132508 A1 | 8/2017 |
| WO | WO 2017/132827 A1 | 8/2017 |
| WO | WO 2017/136820 A2 | 8/2017 |
| WO | WO 2017/143150 A1 | 8/2017 |
| WO | WO 2017/161154 A2 | 9/2017 |
| WO | WO 2017/166804 A2 | 10/2017 |
| WO | WO 2017/192798 A1 | 11/2017 |
| WO | WO 2017/193032 A2 | 11/2017 |
| WO | WO 2017/193094 A1 | 11/2017 |
| WO | WO 2017/194641 A1 | 11/2017 |
| WO | WO 2017/200969 A1 | 11/2017 |
| WO | WO 2017/201502 A1 | 11/2017 |
| WO | WO 2017/202744 A1 | 11/2017 |
| WO | WO 2017/205216 A1 | 11/2017 |
| WO | WO 2017/205801 A1 | 11/2017 |
| WO | WO 2017/207628 A1 | 12/2017 |
| WO | WO 2017/210058 A1 | 12/2017 |
| WO | WO 2017/210453 A1 | 12/2017 |
| WO | WO 2017/210473 A1 | 12/2017 |
| WO | WO 2017/210624 A1 | 12/2017 |
| WO | WO 2017/210631 A1 | 12/2017 |
| WO | WO 2017/210637 A1 | 12/2017 |
| WO | WO 2017/214092 A1 | 12/2017 |
| WO | WO 2017/214182 A1 | 12/2017 |
| WO | WO 2017/218707 A2 | 12/2017 |
| WO | WO 2018/036472 A1 | 3/2018 |
| WO | WO 2018/048975 A1 | 3/2018 |
| WO | WO 2018/053401 A1 | 3/2018 |
| WO | WO 2018/085468 A2 | 5/2018 |
| WO | WO 2018/087143 A2 | 5/2018 |
| WO | WO 2018/101448 A1 | 6/2018 |
| WO | WO 2018/106588 A1 | 6/2018 |
| WO | WO 2018/106864 A1 | 6/2018 |
| WO | WO 2018/110515 A1 | 6/2018 |
| WO | WO 2018/127709 A1 | 7/2018 |
| WO | WO 2018/129714 A1 | 7/2018 |
| WO | WO 2018/154529 A1 | 8/2018 |
| WO | WO 2018/156649 A1 | 8/2018 |
| WO | WO 2018/178250 A1 | 10/2018 |
| WO | WO 2018/183459 A1 | 10/2018 |
| WO | WO 2018/183928 A1 | 10/2018 |
| WO | WO 2018/185043 A1 | 10/2018 |
| WO | WO 2018/185135 A1 | 10/2018 |

OTHER PUBLICATIONS

Irving, "Probodies Empower a New Generation of Antibody Immunotherapies," presented at Keystone Symposia on Molecular and Cellular Biology, Feb. 2015.

Polu et al., "Probody therapeutics for targeting antibodies to diseased tissue." Expert Opinion on Biological Therapy, vol. 14(8): 1049-1053 (2014).

Weidle et al., "Proteases as activators for cytotoxic prodrugs in antitumor therapy," Cancer genomics & proteomics, vol. 11: 67-80 (2014).

Ansari, M.J. et al., "The programmed death-1 (PD-1) pathway regulates autoimmune diabetes in nonobese diabetic (NOD) mice," *J Exp Med.* Jul. 7, 2003; 198(1):63-9.

Wang, C. et al., "In Vitro Characterization of the Anti-PD-1 Antibody Nivolumab, BMS-936558, and In Vivo Toxicology in Non-Human Primates, Cancer Immunology Research," *Cancer Immunol Res.* Sep. 2014; 2(9):846-56. Epub May 28, 2014.

Anonymous (Jan. 1, 2014) "International Nonproprietary Names for Pharmaceutical Substances (INN). Recommended International Nonproprietary Names: List 72" *WHO Drug Information*, 28(3)379-422. Rec. Wld Health Org. Resolution EB15.R7 [online]. Retrieved from the Internet: http://www.who.int/entity/medicines/publications/druginformation/innlists/RL72.pdf?ua= 1 , 44 pages.

Agata, Y. et at (May 1996) "Expression of the PD-1 antigen on the surface of stimulated mouse T and B lymphocytes" Int Immunol. 8(5):765-72.

Angal, S. et al. (Jan. 1993) "A single amino acid substitution abolishes the heterogeneity of chimeric mouse/human (IgG4) antibody" Mol Immunol. 30(1):105-8.

Chen, D. S. et al. (Dec. 2012) "Molecular pathways: next-generation immunotherapy—inhibiting programmed death-ligand 1 and programmed death-1" Clin Cancer Res. 18(24):6580-7.

Guan, M. et al. (Jan. 2015) "Adverse Events of Monoclonal Antibodies Used for Cancer Therapy" *Biomed Res Intl*, Article ID 428169, 13 pages.

(56) References Cited

OTHER PUBLICATIONS

Tipton, K.A. et al. (Jun. 2016) "PD-1 Probody™ Therapeutic Anti-tumor Efficacy and Protection Against Autoimmunity in Preclinical Models" [online]. Retrieved from the Internet: https://cytomx.com/wp-content/uploads/PD-1-ProbodyTM-Therapeutic-Anti-tumor-Efficacy-and-Protection-Against-Autoimmunity-in-Preclinical-Models-AACR-2016.pdf, 1 page.

Center for Drug Evaluation and Research, Application No. 125514Orig1s000, Pharmacology Review(s). Applicant: Merck Share and Dohme Corp., Oct. 2, 2014 [online]. Retrieved from: www.accessdata.fda.gov/drugsatfda_docs/nda/2014/125514orig1s000pharmr.pdf, 97 pages.

Tipton et al, "Abstract #: 219: ProbodyTM Therapeutic Targeting PD-1 Provides Preclinical Anti-tumor Efficacy While Minimizing Induction of Autoimmunity as a Single Agent and in Combination with CTLA-4 Blockade," Poster, Presented at Proceedings of the Society of Immunotherapy of Cancer SITC, South San Francisco CA, Nov. 2016, 1 page.

* cited by examiner

Kd of A1.5 = 0.2948

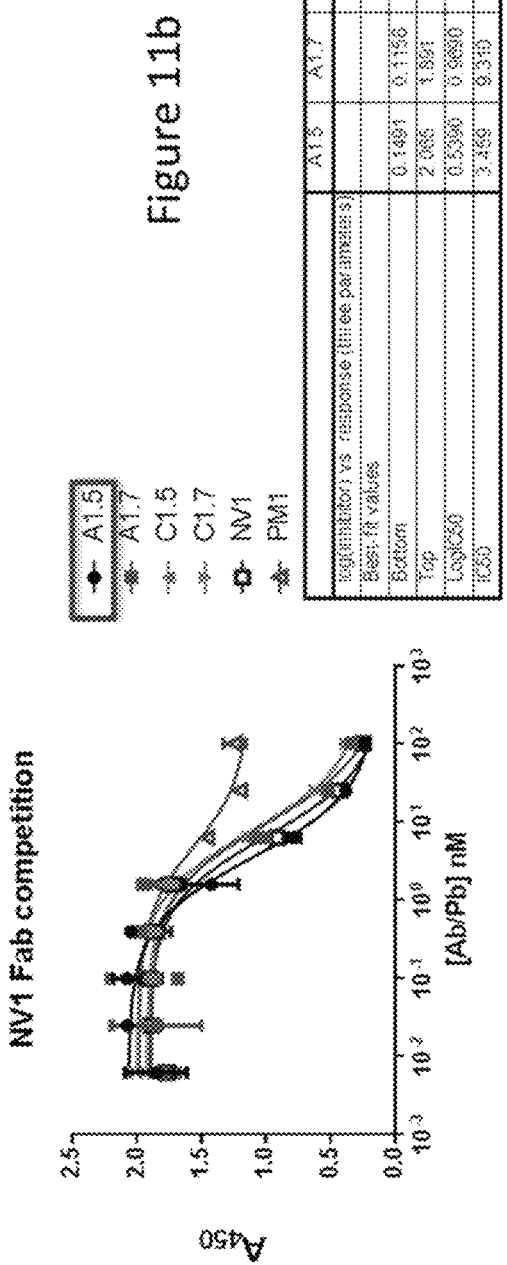

FIGURE 15, cont'd
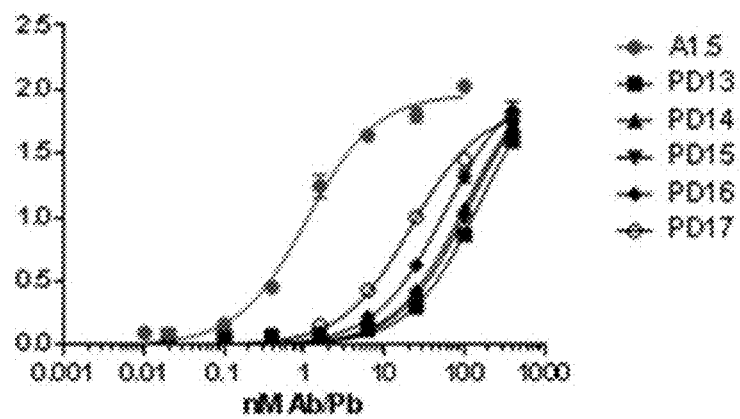
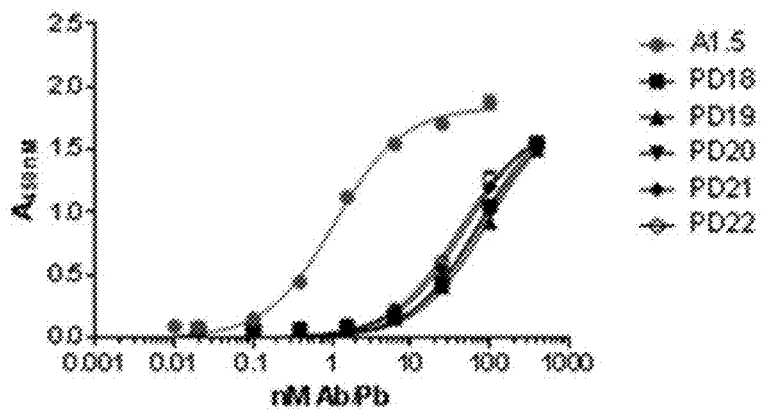

FIGURE 15, cont'd
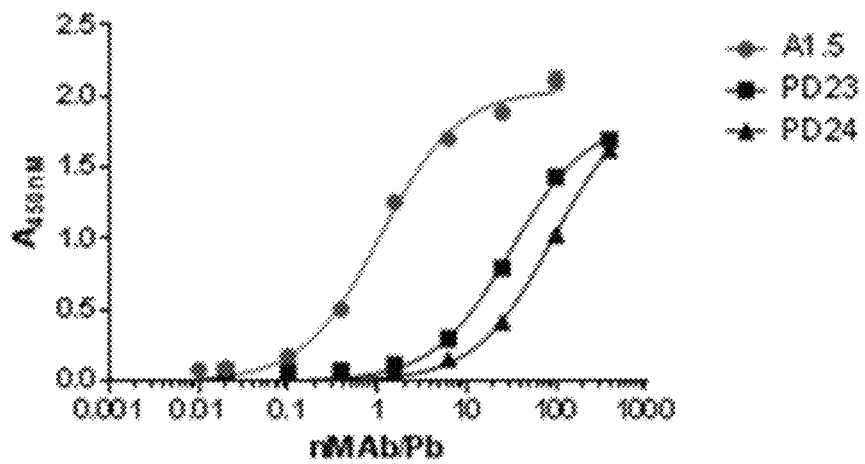
FIGURE 16
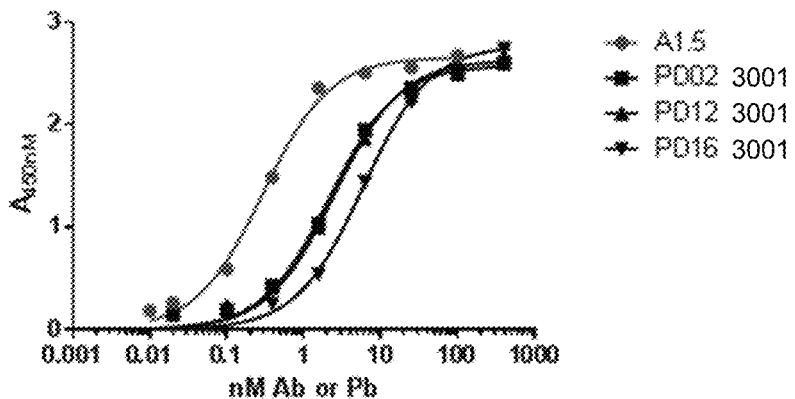

Binding:

| Binding EC50 (nM) |
|---|
| J43v2 |
| 4.308 |

J43 MP 2001 Activatable Antibody ELISA

| Test Article | Dose (mg/kg) | $t_{1/2}$ (days) | $C_{max}$ (ug/mL) | $AUC_{last}$ (day*ug/mL) |
|---|---|---|---|---|
| A1.5 PD34 2001 Activatable Antibody | 1 | 8.5 | 32.1 | 228.8 |
|  | 5 | 14.1 | 153.1 | 1132.2 |
| A1.5 Antibody | 1 | 8.3 | 34.1 | 184.1 |
|  | 5 | 8.7 | 150.8 | 544.0 |

ANTI-PD1 ANTIBODIES, ACTIVATABLE ANTI-PD1 ANTIBODIES, AND METHODS OF USE THEREOF

RELATED APPLICATIONS

This application claims the benefit of U.S. Provisional Application No. 62/191,902, filed Jul. 13, 2015; U.S. Provisional Application No. 62/205,825, filed Aug. 17, 2015; U.S. Provisional Application No. 62/295,314, filed Feb. 15, 2016; U.S. Provisional Application No. 62/323,543, filed Apr. 15, 2016 and U.S. Provisional Application No. 62/333,629, filed May 9, 2016; the contents of each of which are incorporated herein by reference in their entirety.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: CYTM_044_001US_SubSeqList_ ST25.txt, dated recorded Mar. 21, 2019, file size 1.37 MB).

FIELD OF THE INVENTION

The invention relates generally to antibodies that specifically bind programmed cell death protein 1 (PD-1), activatable antibodies that specifically bind to PD-1 and methods of making and using these anti-PD-1 antibodies and anti-PD-1 activatable antibodies in a variety of therapeutic, diagnostic and prophylactic indications.

BACKGROUND OF THE INVENTION

Antibody-based therapies have proven effective treatments for several diseases but in some cases, toxicities due to broad target expression have limited their therapeutic effectiveness. In addition, antibody-based therapeutics have exhibited other limitations such as rapid clearance from the circulation following administration.

Under conditions of chronic stimulation, T cells upregulate and sustain expression of the inhibitory receptor PD-1 to negatively regulate the quality and magnitude of T cell responses. The primary ligand for PD-1, PD-L1 is upregulated on many tumor cells and has been associated with inhibition of anti-tumor T-cell immunity via its engagement of PD-1 on tumor-infiltrating T cells. Clinical trials have confirmed the capacity of antibody blockade of either PD-1 or PD-L1 to restore the activity of durable tumor-specific immunity in patients across multiple tumor types. (Herbst et al, 2014; Lipson et al, 2015). However, because similar mechanisms control anti-tumor immunity and self-tolerance, systemic delivery of these checkpoint-targeted therapies can also induce systemic autoimmunity that can be exacerbated with combination treatments; such as nivolumab or pembrolizumab (anti-PD-1) and ipilimumab (anti-CTLA4). New approaches are therefore needed that provide anti-tumor activity without deregulating systemic immunity.

In the realm of small molecule therapeutics, strategies have been developed to provide prodrugs of an active chemical entity. Such prodrugs are administered in a relatively inactive (or significantly less active) form. Once administered, the prodrug is metabolized in vivo into the active compound. Such prodrug strategies can provide for increased selectivity of the drug for its intended target and for a reduction of adverse effects.

Accordingly, there is a continued need in the field of antibody-based therapeutics for antibodies that mimic the desirable characteristics of the small molecule prodrug.

SUMMARY OF THE INVENTION

The disclosure provides antibodies or antigen-binding fragments thereof that specifically bind programmed cell death protein 1 (PD-1), also known as CD279, SLEB2, and/or hSLE1. The use of the term "PD-1" is intended to cover any variation thereof, such as, by way of non-limiting example, PD1 and/or PD1, all variations are used herein interchangeably. Aberrant expression and/or activity of PD-1 and PD-1-related signaling has been implicated in the pathogenesis of many diseases and disorders, such as cancer.

The present invention provides monoclonal antibodies (mAbs), activatable antibodies, and antigen-binding fragments thereof that specifically bind PD-1.

In some embodiments, the antibody includes an antibody or antigen-binding fragment thereof that specifically binds PD-1. In some embodiments, the antibody or antigen-binding fragment thereof that binds PD-1 is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen-binding fragment thereof that binds PD-1 is a mouse, other rodent, chimeric, humanized or fully human monoclonal antibody.

In some embodiments, the antibody includes an isolated antibody or antigen binding fragment thereof (AB) that specifically binds to mammalian PD-1, wherein the AB has one or more of the characteristics selected from the group consisting of: (a) the AB inhibits binding of mammalian PD-1 to mammalian PDL1 with an EC$_{50}$ value less than 5 nM; (b) the AB inhibits binding of mammalian PD-1 to mammalian PDL2 with an EC$_{50}$ value less than 5 nM; and (c) the AB specifically binds to human PD-1 and cynomolgus monkey PD-1.

In some embodiments, the antibody specifically binds to the mammalian PD-1 with a dissociation constant of 0.01 nM to 5 nM, 0.05 nM to 5 nM, 0.1 nM to 5 nM, 0.2 nM to 5 nM, 0.3 nM to 5 nM, 0.4 nM to 5 nM, 0.5 nM to 5 nM, 0.75 nM to 5 nM, 1 nM to 5 nM, 2 nM to 5 nM, 0.01 nM to 2 nM, 0.05 nM to 2 nM, 0.1 nM to 2 nM, 0.2 nM to 2 nM, 0.3 nM to 2 nM, 0.4 nM to 2 nM, 0.5 nM to 2 nM, 0.75 nM to 1 nM, 1 nM to 2 nM, 0.01 nM to 1 nM, 0.05 nM to 1 nM, 0.1 nM to 1 nM, 0.2 nM to 1 nM, 0.3 nM to 1 nM, 0.4 nM to 1 nM, 0.5 nM to 1 nM, 0.75 nM to 1 nM, 0.01 nM to 0.75 nM, 0.05 nM to 0.75 nM, 0.1 nM to 0.75 nM, 0.2 nM to 0.75 nM, 0.3 nM to 0.75 nM, 0.4 nM to 0.75 nM, 0.5 nM to 0.75 nM, 0.01 nM to 0.5 nM, 0.05 nM to 0.5 nM, 0.1 nM to 0.5 nM, 0.2 nM to 0.5 nM, 0.3 nM to 0.5 nM, 0.4 nM to 0.5 nM, 0.01 nM to 0.4 nM, 0.05 nM to 0.4 nM, 0.1 nM to 0.4 nM, 0.2 nM to 0.4 nM, 0.3 nM to 0.4 nM, 0.01 nM to 0.3 nM, 0.05 nM to 0.3 nM, 0.1 nM to 0.3 nM, 0.2 nM to 0.3 nM, 0.01 nM to 0.2 nM, 0.05 nM to 0.2 nM, 0.1 nM to 0.2 nM, 0.01 nM to 0.1 nM, 0.05 nM to 0.1 nM, or 0.01 nM to 0.05 nM.

In some embodiments, the mammalian PD-1 is selected from the group consisting of a human PD-1 and a cynomolgus monkey PD-1. In some embodiments, the mammalian PD-1 is a murine PD-1. In some embodiments, the antibody specifically binds to human PD-1 or cynomolgus monkey PD-1 with a dissociation constant of less than or equal to 1 nM. In some embodiments, the mammalian PD-1 is a human PD-1.

In some embodiments, the antibody or antigen binding fragment thereof specifically binds to the mammalian PD-1 with a dissociation constant is less than or equal to 0.01 nM, less than or equal to 0.05 nM, less than or equal to 0.1 nM, less than or equal to 0.2 nM, less than or equal to 0.3 nM, less than or equal to 0.4 nM, less than or equal to 0.5 nM, less than or equal to 0.75 nM, and less than or equal to 1 nM.

In some embodiments, the antibody has one or more of the characteristics selected from the group consisting of: (a) the AB specifically binds human PD-1 and cynomolgus monkey PD-1; (b) the AB inhibits binding of human PDL1 and human PDL2 to human PD-1; (c) the AB inhibits binding of cynomolgus monkey PDL1 and cynomolgus monkey PDL2 to cynomolgus monkey PD-1; (d) the AB specifically binds to murine PD-1; and (e) the AB inhibits binding of murine PDL1 and murine PDL2 to murine PD-1.

In some embodiments, the antibody blocks the ability of a natural ligand to bind to the mammalian PDL1 with an $EC_{50}$ of 0.1 nM to 10 nM, 0.1 nM to 5 nM, 0.1 nM to 3 nM, 0.1 nM to 2 nM, 0.1 nM to 1 nM, 0.1 nM to 0.5 nM, 0.1 nM to 0.25 nM, 0.25 nM to 10 nM, 0.25 nM to 5 nM, 0.25 nM to 3 nM, 0.25 nM to 2 nM, 0.25 nM to 1 nM, 0.25 nM to 0.5 nM, 0.5 nM to 10 nM, 0.5 nM to 5 nM, 0.5 nM to 3 nM, 0.5 nM to 2 nM, 0.5 nM to 1 nM, 1 nM to 10 nM, 1 nM to 5 nM, 1 nM to 3 nM, 1 nM to 2 nM, 2 nM to 10 nM, 2 nM to 5 nM, 2 nM to 3 nM, 3 nM to 10 nM, 3 nM to 5 nM, or 5 nM to 10 nM. In some embodiments, the natural ligand is a mammalian PDL1 or a mammalian PDL2. In some embodiments, the natural ligand is selected from the group consisting of: a human PDL1, a human PDL2, a cynomolgus monkey PDL1, and a cynomolgus monkey PDL2. In some embodiments, the natural ligand is a murine PDL1 or a murine PDL2.

In some embodiments, the antibody blocks the ability of a natural ligand to bind to the mammalian PDL1 with an $EC_{50}$ of less than or equal to 0.1 nM, less than or equal to 0.25 nM, less than or equal to 0.5 nM, less than or equal to 1 nM, less than or equal to 2 nM, less than or equal to 3 nM, less than or equal to 4 nM, less than or equal to 5 nM or less than or equal to 10 nM.

In some embodiments, the anti-PD-1 antibody includes a heavy chain that comprises or is derived from an amino acid sequence selected from the group consisting of SEQ ID NO: 1, 5, 9, 13, 17, 21, 23, 25, 27, 29, 31, 33, 35, and 37, and a light chain that comprises or is derived from an amino acid sequence selected from the group consisting of SEQ ID NO: 3, 7, 11, 15, 19, 39, 41, 43, 45, 47, 49, 51, 53, 55, 57, and 59.

In some embodiments, the anti-PD-1 antibody includes a heavy chain that comprises or is derived from an amino acid sequence selected from the group consisting of SEQ ID NO: 21, 23, 25, 27, 29, 31, 33, 35, and 37, and a light chain that comprises or is derived from an amino acid sequence selected from the group consisting of SEQ ID NO: 39, 41, 43, 45, 47, 49, 51, 53, 55, 57, and 59.

In some embodiments, the anti-PD-1 antibody includes a heavy chain that comprises or is derived from amino acid sequence SEQ ID NO: 21. In some embodiments, the anti-PD-1 antibody includes a light chain that comprises or is derived from amino acid sequence SEQ ID NO: 45 or SEQ ID NO: 47. In some embodiments, the anti-PD-1 antibody includes a heavy chain that comprises or is derived from amino acid sequence SEQ ID NO: 21 and a light chain that comprises or is derived from amino acid sequence SEQ ID NO: 45. In some embodiments, the anti-PD-1 antibody includes a heavy chain that comprises or is derived from amino acid sequence SEQ ID NO: 21 and a light chain that comprises or is derived from amino acid sequence SEQ ID NO: 47.

In some embodiments, the anti-PD-1 antibody includes the combination of the complementarity determining region (CDR) sequences of the heavy chain amino acid sequence of SEQ ID NO: 21. In some embodiments, the anti-PD-1 antibody includes the combination of the CDR sequences of the light chain amino acid sequence of SEQ ID NO: 45 or of SEQ ID NO: 47. In some embodiments, the anti-PD-1 antibody includes a combination of the CDR sequences of the heavy chain amino acid sequence of SEQ ID NO: 21, and the CDR sequences of the light chain amino acid sequence of SEQ ID NO: 45 or 47. In some embodiments, the anti-PD-1 antibody includes a combination of the CDR sequences of the heavy chain amino acid sequence of SEQ ID NO: 21, and the CDR sequences of the light chain amino acid sequence of SEQ ID NO: 45. In some embodiments, the anti-PD-1 antibody includes a combination of the CDR sequences of the heavy chain amino acid sequence of SEQ ID NO: 21, and the CDR sequences of the light chain amino acid sequence of SEQ ID NO: 47.

In some embodiments, the anti-PD-1 antibody includes: (a) a variable heavy chain complementarity determining region 1 (VH CDR1) comprising an amino acid sequence selected from the group consisting of SEQ ID NOs: 653-657; (b) a variable heavy chain complementarity determining region 2 (VH CDR2) comprising an amino acid sequence selected from the group consisting of SEQ ID NOs: 658-663; (c) a variable heavy chain complementarity determining region 3 (VH CDR3) comprising an amino acid sequence selected from the group consisting of SEQ ID NOs: 664-668; (d) a variable light chain complementarity determining region 1 (VL CDR1) comprising an amino acid sequence selected from the group consisting of SEQ ID NOs:669-677; (e) a variable light chain complementarity determining region 2 (VL CDR2) comprising an amino acid sequence selected from the group consisting of SEQ ID NOs: 678-682; and (f) variable light chain complementarity determining region 3 (VL CDR3) comprising an amino acid sequence selected from the group consisting of SEQ ID NOs: 683-687.

In some embodiments, the anti-PD-1 antibody includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664).

In some embodiments, the anti-PD-1 antibody includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, the anti-PD-1 antibody includes a combination of a VL CDR1 sequence, a VL CDR2 sequence, and a VL CDR3 sequence, wherein the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, the anti-PD-1 antibody includes a combination of a VL CDR1 sequence, a VL CDR2 sequence, and a VL CDR3 sequence, wherein the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, the anti-PD-1 antibody includes a heavy chain that comprises or is derived from the amino acid sequence of SEQ ID NO: 1346, and a light chain that comprises or is derived from the amino acid sequence of SEQ ID NO: 626.

In some embodiments, the anti-PD-1 antibody includes a heavy chain that comprises or is derived from the amino acid sequence of SEQ ID NO: 1514, and a light chain that comprises or is derived from the amino acid sequence of SEQ ID NO: 638.

In some embodiments, the anti-PD-1 antibody includes the combination of the complementarity determining region (CDR) sequences of the heavy chain amino acid sequence of SEQ ID NO: 1346. In some embodiments, the anti-PD-1 antibody includes the combination of the CDR sequences of the light chain amino acid sequence of SEQ ID NO: 626. In some embodiments, the anti-PD-1 antibody includes a combination of the CDR sequences of the heavy chain amino acid sequence of SEQ ID NO: 1346, and the CDR sequences of the light chain amino acid sequence of SEQ ID NO: 626.

In some embodiments, the anti-PD-1 antibody includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GITFSNSG (SEQ ID NO: 1705); the VH CDR2 sequence comprises IWYDGSKR (SEQ ID NO: 1706); and the VH CDR3 sequence comprises TNDDY (SEQ ID NO: 1707).

In some embodiments, the anti-PD-1 antibody includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GITFSNSG (SEQ ID NO: 1705); the VH CDR2 sequence comprises IWYDGSKR (SEQ ID NO: 1706); the VH CDR3 sequence comprises TNDDY (SEQ ID NO: 1707); the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, the anti-PD-1 antibody includes the combination of the complementarity determining region (CDR) sequences of the heavy chain amino acid sequence of SEQ ID NO: 1514. In some embodiments, the anti-PD-1 antibody includes the combination of the CDR sequences of the light chain amino acid sequence of SEQ ID NO: 638. In some embodiments, the anti-PD-1 antibody includes a combination of the CDR sequences of the heavy chain amino acid sequence of SEQ ID NO: 1514, and the CDR sequences of the light chain amino acid sequence of SEQ ID NO: 638.

In some embodiments, the anti-PD-1 antibody includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GYTFTNYY (SEQ ID NO: 1711); the VH CDR2 sequence comprises INPSNGGT (SEQ ID NO: 1712); and the VH CDR3 sequence comprises RRDYRFDMGFDY (SEQ ID NO: 1713).

In some embodiments, the anti-PD-1 antibody includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GYTFTNYY (SEQ ID NO: 1711); the VH CDR2 sequence comprises INPSNGGT (SEQ ID NO: 1712); the VH CDR3 sequence comprises RRDYRFDMGFDY (SEQ ID NO: 1713); the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37. In some embodiments, the antibody comprises a light chain amino acid that is at least 90%, 91%, 92%, 93%, 94%, 95%, 96%, 97%, 98% or 99% identical to an amino acid sequence selected from the group consisting of SEQ ID NO: 3, 7, 11, 15, 19, 39, 41, 43, 45, 47, 49, 51, 53, 55, 57, and 59. In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence selected from the group consisting of SEQ ID NO: 3, 7, 11, 15, 19, 39, 41, 43, 45, 47, 49, 51, 53, 55, 57, and 59.

In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37. In some embodiments, the antibody comprises a light chain amino acid that is at least 90%, 91%, 92%, 93%, 94%, 95%, 96%, 97%, 98% or 99% identical to an amino acid sequence selected from the group consisting of SEQ ID NO: 39, 41, 43, 45, 47, 49, 51, 53, 55, 57, and 59. In some embodiments, the antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence selected from the group consisting of SEQ ID NO: 39, 41, 43, 45, 47, 49, 51, 53, 55, 57, and 59. In some embodiments, the anti-PD-1 antibody includes a heavy chain sequence that is at least 90%, 91%, 92%, 93%, 94%, 95%, 96%, 97%, 98% or 99% identical to the amino acid sequence of SEQ ID NO: 21, and a light chain sequence that is at least 90%, 91%, 92%, 93%, 94%, 95%, 96%, 97%, 98% or 99% identical to the amino acid sequence of SEQ ID NO: 45 or SEQ ID NO: 47. In some embodiments, the anti-PD-1 antibody includes a heavy chain sequence that is at least 90%, 91%, 92%, 93%, 94%, 95%, 96%, 97%, 98% or 99% identical to the amino acid sequence of SEQ ID NO: 21, and a light chain sequence that is at least 90%, 91%, 92%, 93%, 94%, 95%, 96%, 97%, 98% or 99% identical to the amino acid sequence of SEQ ID NO: 45. In some embodiments, the anti-PD-1 antibody includes a heavy chain sequence that is at least 90%, 91%, 92%, 93%, 94%, 95%, 96%, 97%, 98% or 99% identical to the amino acid sequence of SEQ ID NO: 21, and a light chain sequence that is at least 90%, 91%, 92%, 93%, 94%, 95%, 96%, 97%, 98% or 99% identical to the amino acid sequence of SEQ ID NO: 47.

In some embodiments, the anti-PD-1 antibody includes a heavy chain amino acid sequence that is at least 90%, 91%, 92%, 93%, 94%, 95%, 96%, 97%, 98% or 99% identical to the amino acid sequence of SEQ ID NO: 1346, and a light chain amino acid sequence that is at least 90%, 91%, 92%, 93%, 94%, 95%, 96%, 97%, 98% or 99% identical to the amino acid sequence of SEQ ID NO: 626.

In some embodiments, the anti-PD-1 antibody includes a heavy chain amino acid sequence that is at least 90%, 91%, 92%, 93%, 94%, 95%, 96%, 97%, 98% or 99% identical to the amino acid sequence of SEQ ID NO: 1514, and a light chain amino acid sequence that is at least 90%, 91%, 92%, 93%, 94%, 95%, 96%, 97%, 98% or 99% identical to the amino acid sequence of SEQ ID NO: 638.

In some embodiments, the antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 8; a VH CDR2 sequence shown in Table 8; a VH CDR3 sequence shown in Table 8; a VL CDR1 sequence shown in Table 8; a VL CDR2 sequence shown in Table 8; and a VL CDR3 sequence shown in Table 8.

In some embodiments, the antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 8; a VH CD2 sequence that includes a sequence that is at least 90%, 91%, 92%, 93%, 94%, 95%, 96%, 97%, 98%, 99% or more identical to a VH CDR2 sequence shown in Table 8; a VH CDR3 sequence that includes a sequence that is at least 90%, 91%, 92%, 93%, 94%, 95%, 96%, 97%, 98%, 99% or more identical to a VH CDR3 sequence shown in Table 8; a VL CDR1 sequence that includes a sequence that is at least 90%, 91%, 92%, 93%, 94%, 95%, 96%, 97%, 98%, 99% or more identical to a VL CDR1 sequence shown in Table 8; a VL CDR2 sequence that includes a sequence that is at least 90%, 91%, 92%, 93%, 94%, 95%, 96%, 97%, 98%, 99% or more identical to a VL CDR2 sequence shown in Table 8; and a VL CDR3 sequence that includes a sequence that is at least 90%, 91%, 92%, 93%, 94%, 95%, 96%, 97%, 98%, 99% or more identical to a VL CDR3 sequence shown in Table 8.

In some embodiments, the antibody comprises a heavy chain that comprises a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 8.

In some embodiments, the antibody comprises a light chain that comprises a combination of a VL CDR1 sequence, a VL CDR2 sequence, and a VL CDR3 sequence, wherein the combination is a combination of the three light chain CDR sequences (VL CDR1, VL CDR2, VL CDR3) shown in a single row in Table 8.

In some embodiments, the antibody comprises a combination of a VH CDR1 sequence, a VH CDR2 sequence, a VH CDR3 sequence shown in a single row in Table 8, and a VL CDR1 sequence, a VL CDR2 sequence, and a VL CDR3 sequence shown in a single row in Table 8.

In some embodiments, the antibody comprises a combination of a VH CDR1 sequence, a VH CDR2 sequence, a VH CDR3 sequence shown in a single row in Table 8, and a VL CDR1 sequence, a VL CDR2 sequence, and a VL CDR3 sequence shown in a single row in Table 8, wherein each CDR sequence in the combination comprises a sequence that is at least 90%, 91%, 92%, 93%, 94%, 95%, 96%, 97%, 98%, 99% or more identical to the corresponding VH CDR sequence shown in a single row in Table 8 and the corresponding VL CDR shown in a single row in Table 8.

In some embodiments, the antibody comprises a heavy chain that comprises a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 8.

In some embodiments, the antibody comprises a light chain that comprises a combination of a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three light chain CDR sequences (VL CDR1, VL CDR2, VL CDR3) shown in a single row in Table 8.

In some embodiments, the antibody includes a combination of a VH CDR1 sequence, a VH CDR2 sequence, and a VH CDR3 sequence, wherein the VH CDR1 sequence comprises a sequence that is at least 90%, 91%, 92%, 93%, 94%, 95%, 96%, 97%, 98%, 99% or more identical to GITFSNSG (SEQ ID NO: 1705); the VH CDR2 sequence comprises a sequence that is at least 90%, 91%, 92%, 93%, 94%, 95%, 96%, 97%, 98%, 99% or more identical to IWYDGSKR (SEQ ID NO: 1706); and the VH CDR3 sequence comprises a sequence that is at least 90%, 91%, 92%, 93%, 94%, 95%, 96%, 97%, 98%, 99% or more identical to TNDDY (SEQ ID NO: 1707).

In some embodiments, the anti-PD-1 antibody includes a combination of a VL CDR1 sequence, a VL CDR2 sequence, and a VL CDR3 sequence, wherein the VL CDR1 sequence comprises a sequence that is at least 90%, 91%, 92%, 93%, 94%, 95%, 96%, 97%, 98%, 99% or more identical to QSVSSY (SEQ ID NO: 1708); the VL CDR2 sequence comprises a sequence that is at least 90%, 91%, 92%, 93%, 94%, 95%, 96%, 97%, 98%, 99% or more identical to DAS (SEQ ID NO: 1709); and the VL CDR3 sequence comprises a sequence that is at least 90%, 91%, 92%, 93%, 94%, 95%, 96%, 97%, 98%, 99% or more identical to QQSSNWPRT (SEQ ID NO: 1710).

In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to GITFSNSG (SEQ ID NO: 1705); the VH CDR2 sequence comprises a sequence that is at least 90%, 91%, 92%, 93%, 94%, 95%, 96%, 97%, 98%, 99% or more identical to IWYDGSKR (SEQ ID NO: 1706); the VH CDR3 sequence comprises a sequence that is at least 90%, 91%, 92%, 93%, 94%, 95%, 96%, 97%, 98%, 99% or more identical to TNDDY (SEQ ID NO: 1707); the VL CDR1 sequence comprises a sequence that is at least 90%, 91%, 92%, 93%, 94%, 95%, 96%, 97%, 98%, 99% or more identical to QSVSSY (SEQ ID NO: 1708); the VL CDR2 sequence comprises a sequence that is at least 90%, 91%, 92%, 93%, 94%, 95%, 96%, 97%, 98%, 99% or more identical to DAS (SEQ ID NO: 1709); and the VL CDR3 sequence comprises a sequence that is at least 90%, 91%, 92%, 93%, 94%, 95%, 96%, 97%, 98%, 99% or more identical to QQSSNWPRT (SEQ ID NO: 1710).

In some embodiments, the antibody includes a combination of a VH CDR1 sequence, a VH CDR2 sequence, and a VH CDR3 sequence, wherein the VH CDR1 sequence comprises a sequence that is at least 90%, 91%, 92%, 93%, 94%, 95%, 96%, 97%, 98%, 99% or more identical to GYTFTNYY (SEQ ID NO: 1711); the VH CDR2 sequence comprises a sequence that is at least 90%, 91%, 92%, 93%, 94%, 95%, 96%, 97%, 98%, 99% or more identical to INPSNGGT (SEQ ID NO: 1712); and the VH CDR3 sequence comprises a sequence that is at least 90%, 91%, 92%, 93%, 94%, 95%, 96%, 97%, 98%, 99% or more identical to RRDYRFDMGFDY (SEQ ID NO: 1713).

In some embodiments, the anti-PD-1 antibody includes a combination of a VL CDR1 sequence, a VL CDR2 sequence, and a VL CDR3 sequence, wherein the VL CDR1 sequence comprises a sequence that is at least 90%, 91%, 92%, 93%, 94%, 95%, 96%, 97%, 98%, 99% or more identical to KGVSTSGYSY (SEQ ID NO: 1714); the VL CDR2 sequence comprises a sequence that is at least 90%, 91%, 92%, 93%, 94%, 95%, 96%, 97%, 98%, 99% or more identical to LAS (SEQ ID NO: 1715); and the VL CDR3 sequence comprises a sequence that is at least 90%, 91%, 92%, 93%, 94%, 95%, 96%, 97%, 98%, 99% or more identical to QHSRDLPLT (SEQ ID NO: 1716).

In some embodiments, the anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to GYTFTNYY (SEQ ID NO: 1711); the VH CDR2 sequence comprises a sequence that is at least 90%, 91%, 92%, 93%, 94%, 95%, 96%, 97%, 98%, 99% or more identical to INPSNGGT (SEQ ID NO: 1712); the VH CDR3 sequence comprises a sequence that is at least 90%, 91%, 92%, 93%, 94%, 95%, 96%, 97%, 98%, 99% or more identical to RRDYRFDMGFDY (SEQ ID NO: 1713); the VL CDR1 sequence comprises a sequence that is at least 90%, 91%, 92%, 93%, 94%, 95%, 96%, 97%, 98%, 99% or more identical to KGVSTSGYSY (SEQ ID NO: 1714); the VL CDR2 sequence comprises a sequence that is at least 90%, 91%, 92%, 93%, 94%, 95%, 96%, 97%, 98%, 99% or more identical to LAS (SEQ ID NO: 1715); and the VL CDR3 sequence comprises a sequence that is at least 90%, 91%, 92%, 93%, 94%, 95%, 96%, 97%, 98%, 99% or more identical to QHSRDLPLT (SEQ ID NO: 1716).

In some embodiments, the antibody is encoded by a nucleic acid sequence that comprises a nucleic acid sequence encoding a heavy chain amino acid sequence selected from the group consisting of SEQ ID NO: 1, 5, 9, 13, 17, 21, 23, 25, 27, 29, 31, 33, 35, and 37. In some embodiments, the antibody is encoded by a nucleic acid sequence that comprises a nucleic acid sequence encoding a heavy chain amino acid sequence selected from the group consisting of SEQ ID NO: 21, 23, 25, 27, 29, 31, 33, 35, and 37.

In some embodiments, the antibody is encoded by a nucleic acid sequence that comprises a nucleic acid sequence encoding a light chain amino acid sequence selected from the group consisting of SEQ ID NO: 3, 7, 11, 15, 19, 39, 41, 43, 45, 47, 49, 51, 53, 55, 57, and 59. In some embodiments, the antibody is encoded by a nucleic acid sequence that comprises a nucleic acid sequence encoding a light chain amino acid sequence selected from the group consisting of SEQ ID NO: 39, 41, 43, 45, 47, 49, 51, 53, 55, 57, and 59.

In some embodiments, the antibody is encoded by a nucleic acid sequence that comprises a nucleic acid sequence encoding a heavy chain amino acid sequence selected from the group consisting of SEQ ID NO: 1, 5, 9, 13, 17, 21, 23, 25, 27, 29, 31, 33, 35, and 37, and a nucleic acid sequence that comprises a nucleic acid sequence encoding a light chain amino acid sequence selected from the group consisting of SEQ ID NO: 3, 7, 11, 15, 19, 39, 41, 43, 45, 47, 49, 51, 53, 55, 57, and 59.

In some embodiments, the antibody is encoded by a nucleic acid sequence that comprises a nucleic acid sequence encoding a heavy chain amino acid sequence selected from the group consisting of SEQ ID NO: 21, 23, 25, 27, 29, 31, 33, 35, and 37, and a nucleic acid sequence that comprises a nucleic acid sequence encoding a light chain amino acid sequence selected from the group consisting of SEQ ID NO: 39, 41, 43, 45, 47, 49, 51, 53, 55, 57, and 59.

In some embodiments, the anti-PD-1 is encoded by a nucleic acid sequence that comprises a nucleic acid sequence encoding a heavy chain that comprises or is derived from the amino acid sequence of SEQ ID NO: 1346, and a nucleic acid sequence that comprises a nucleic acid sequence encoding a light chain that comprises or is derived from the amino acid sequence of SEQ ID NO: 626.

In some embodiments, the anti-PD-1 antibody is encoded by a nucleic acid sequence that comprises a nucleic acid sequence encoding a heavy chain that comprises or is derived from the amino acid sequence of SEQ ID NO: 1514, and a nucleic acid sequence that comprises a nucleic acid sequence encoding a light chain that comprises or is derived from the amino acid sequence of SEQ ID NO: 638.

In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37. In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37.

In some embodiments, the antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 3, 7, 11, 15, 19, 39, 41, 43, 45, 47, 49, 51, 53, 55, 57, and 59. In some embodiments, the antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 39, 41, 43, 45, 47, 49, 51, 53, 55, 57, and 59.

In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37, and a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 3, 7, 11, 15, 19, 39, 41, 43, 45, 47, 49, 51, 53, 55, 57, and 59.

In some embodiments, the antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 39, 41, 43, 45, 47, 49, 51, 53, 55, 57, and 59.

In some embodiments, the anti-PD-1 is encoded by a nucleic acid sequence that comprises a nucleic acid sequence encoding a heavy chain that is at least 90%, 91%, 92%, 93%, 94%, 95%, 96%, 97%, 98% or 99% identical to the amino acid sequence of SEQ ID NO: 1346, and a nucleic acid sequence that comprises a nucleic acid sequence encoding a light chain t that is at least 90%, 91%, 92%, 93%, 94%, 95%, 96%, 97%, 98% or 99% identical to the amino acid sequence of SEQ ID NO: 626.

In some embodiments, the anti-PD-1 antibody is encoded by a nucleic acid sequence that comprises a nucleic acid sequence encoding a heavy chain that is at least 90%, 91%, 92%, 93%, 94%, 95%, 96%, 97%, 98% or 99% identical to the amino acid sequence of SEQ ID NO: 1514, and a nucleic acid sequence that comprises a nucleic acid sequence encoding a light chain that is at least 90%, 91%, 92%, 93%, 94%, 95%, 96%, 97%, 98% or 99% identical to the amino acid sequence of SEQ ID NO: 638.

In some embodiments, the antibody is encoded by a heavy chain nucleic acid sequence selected from the group consisting of SEQ ID NO: 2, 6, 10, 14, 18, 22, 24, 26, 28, 30, 32, 34, 36, and 38. In some embodiments, the antibody is encoded by a heavy chain nucleic acid sequence selected from the group consisting of SEQ ID NO: 22, 24, 26, 28, 30, 32, 34, 36, and 38.

In some embodiments, the antibody is encoded by a light chain nucleic acid sequence selected from the group consisting of SEQ ID NO: 4, 8, 12, 16, 20, 40, 42, 44, 46, 48, 50, 52, 54, 56, 58, and 60. In some embodiments, the antibody is encoded by a light chain nucleic acid sequence selected from the group consisting of SEQ ID NO: 40, 42, 44, 46, 48, 50, 52, 54, 56, 58, and 60.

In some embodiments, the antibody is encoded by heavy chain nucleic acid sequence selected from the group consisting of SEQ ID NO: selected from the group consisting of SEQ ID NO: 2, 6, 10, 14, 18, 22, 24, 26, 28, 30, 32, 34, 36, and 38, and a light chain nucleic acid sequence selected from the group consisting of SEQ ID NO: 4, 8, 12, 16, 20, 40, 42, 44, 46, 48, 50, 52, 54, 56, 58, and 60. In some embodiments, the antibody is encoded by heavy chain nucleic acid sequence selected from the group consisting of SEQ ID NO: selected from the group consisting of SEQ ID NO: 22, 24, 26, 28, 30, 32, 34, 36, and 38, and a light chain nucleic acid sequence selected from the group consisting of SEQ ID NO: 40, 42, 44, 46, 48, 50, 52, 54, 56, 58, and 60.

In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 2, 6, 10, 14, 18, 22, 24, 26, 28, 30, 32, 34, 36, and 38. In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 22, 24, 26, 28, 30, 32, 34, 36, and 38.

In some embodiments, the antibody is encoded by a nucleic acid sequence that is at least 90%, 91%, 92%, 93%, 94%, 95%, 96%, 97%, 98% or 99% identical to a light chain nucleic acid sequence selected from the group consisting of SEQ ID NO: 4, 8, 12, 16, 20, 40, 42, 44, 46, 48, 50, 52, 54, 56, 58, and 60. In some embodiments, the antibody is encoded by a nucleic acid sequence that is at least 90%, 91%, 92%, 93%, 94%, 95%, 96%, 97%, 98% or 99% identical to a light chain nucleic acid sequence selected from the group consisting of SEQ ID NO: 40, 42, 44, 46, 48, 50, 52, 54, 56, 58, and 60.

In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 2, 6, 10, 14, 18, 22, 24, 26, 28, 30, 32, 34, 36, and 38, and a nucleic acid sequence that is at least 90%, 91%, 92%, 93%, 94%, 95%, 96%, 97%, 98% or 99% identical to a light chain nucleic acid sequence selected from the group consisting of SEQ ID NO: 4, 8, 12, 16, 20, 40, 42, 44, 46, 48, 50, 52, 54, 56, 58, and 60. In some embodiments, the antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 22, 24, 26, 28, 30, 32, 34, 36, and 38, and a nucleic acid sequence that is at least 90%, 91%, 92%, 93%, 94%, 95%, 96%, 97%, 98% or 99% identical to a light chain nucleic acid sequence selected from the group consisting of SEQ ID NO: 40, 42, 44, 46, 48, 50, 52, 54, 56, 58, and 60.

In some embodiments, the antibody or antigen-binding fragment thereof is incorporated in a multispecific antibody or antigen-binding fragment thereof, where at least one arm of the multispecific antibody specifically binds PD-1. In some embodiments, the antibody or antigen-binding fragment thereof is incorporated in a bispecific antibody or antigen-binding fragment thereof, where at least one arm of the bispecific antibody specifically binds PD-1.

In some embodiments, at least one arm of the multispecific antibody, e.g., a bispecific antibody, comprises a heavy chain amino acid sequence selected from the group consisting of SEQ ID NO: 1, 5, 9, 13, 17, 21, 23, 25, 27, 29, 31, 33, 35, and 37. In some embodiments, at least one arm of the multispecific antibody, e.g., a bispecific antibody, comprises a heavy chain amino acid sequence selected from the group consisting of SEQ ID NO: 21, 23, 25, 27, 29, 31, 33, 35, and 37.

In some embodiments, at least one arm of the multispecific antibody, e.g., a bispecific antibody, comprises a light chain amino acid sequence selected from the group consisting of SEQ ID NO: 3, 7, 11, 15, 19, 39, 41, 43, 45, 47, 49, 51, 53, 55, 57, and 59. In some embodiments, at least one arm of the multispecific antibody, e.g., a bispecific antibody, comprises a light chain amino acid sequence selected from the group consisting of SEQ ID NO: 39, 41, 43, 45, 47, 49, 51, 53, 55, 57, and 59.

In some embodiments, at least one arm of the multispecific antibody, e.g., a bispecific antibody, includes a heavy chain amino acid sequence comprising an amino acid sequence selected from the group consisting of SEQ ID NO: 1, 5, 9, 13, 17, 21, 23, 25, 27, 29, 31, 33, 35, and 37, and a light chain amino acid sequence selected from the group consisting of SEQ ID NO: 3, 7, 11, 15, 19, 39, 41, 43, 45, 47, 49, 51, 53, 55, 57, and 59. In some embodiments, at least one arm of the multispecific antibody, e.g., a bispecific antibody, includes a heavy chain amino acid sequence comprising an amino acid sequence selected from the group consisting of SEQ ID NO: 21, 23, 25, 27, 29, 31, 33, 35, and 37, and a light chain amino acid sequence selected from the group consisting of SEQ ID NO: 39, 41, 43, 45, 47, 49, 51, 53, 55, 57, and 59.

In some embodiments, at least one arm of the multispecific antibody, e.g., a bispecific antibody, includes a heavy chain that comprises or is derived from amino acid sequence SEQ ID NO: 21. In some embodiments, at least one arm of the multispecific antibody, e.g., a bispecific antibody, includes a light chain that comprises or is derived from amino acid sequence SEQ ID NO: 45 or SEQ ID NO: 47. In some embodiments, at least one arm of the multispecific antibody, e.g., a bispecific antibody, includes a heavy chain that comprises or is derived from amino acid sequence SEQ ID NO: 21 and a light chain that comprises or is derived from amino acid sequence SEQ ID NO: 45 or SEQ ID NO: 47. In some embodiments, at least one arm of the multispecific antibody, e.g., a bispecific antibody, includes a heavy chain that comprises or is derived from amino acid sequence SEQ ID NO: 21 and a light chain that comprises or is derived from amino acid sequence SEQ ID NO: 45. In some embodiments, at least one arm of the multispecific antibody, e.g., a bispecific antibody, includes a heavy chain that comprises or is derived from amino acid sequence SEQ ID NO: 21 and a light chain that comprises or is derived from amino acid sequence SEQ ID NO: 47.

In some embodiments, at least one arm of the multispecific antibody, e.g., a bispecific antibody, includes the combination of the complementarity determining region (CDR) sequences of the heavy chain amino acid sequence of SEQ ID NO: 21. In some embodiments, at least one arm of the multispecific antibody, e.g., a bispecific antibody, includes the combination of the CDR sequences of the light chain amino acid sequence of SEQ ID NO: 45 or of SEQ ID NO: 47. In some embodiments, at least one arm of the multispecific antibody, e.g., a bispecific antibody, includes a combination of the CDR sequences of the heavy chain amino acid sequence of SEQ ID NO: 21, and the CDR sequences of the light chain amino acid sequence of SEQ ID NO: 45 or 47. In some embodiments, at least one arm of the multispecific antibody, e.g., a bispecific antibody, includes a combination of the CDR sequences of the heavy chain amino acid sequence of SEQ ID NO: 21, and the CDR sequences of the light chain amino acid sequence of SEQ ID NO: 45. In some embodiments, at least one arm of the multispecific antibody, e.g., a bispecific antibody, includes a combination of the CDR sequences of the heavy chain amino acid sequence of SEQ ID NO: 21, and the CDR sequences of the light chain amino acid sequence of SEQ ID NO: 47.

In some embodiments, at least one arm of the multispecific antibody, e.g., a bispecific antibody includes: (a) a variable heavy chain complementarity determining region 1 (VH CDR1) comprising an amino acid sequence selected from the group consisting of SEQ ID NOs: 653-657; (b) a variable heavy chain complementarity determining region 2 (VH CDR2) comprising an amino acid sequence selected from the group consisting of SEQ ID NOs: 658-663; (c) a variable heavy chain complementarity determining region 3 (VH CDR3) comprising an amino acid sequence selected from the group consisting of SEQ ID NOs: 664-668; (d) a variable light chain complementarity determining region 1 (VL CDR1) comprising an amino acid sequence selected from the group consisting of SEQ ID NOs:669-677; (e) a variable light chain complementarity determining region 2 (VL CDR2) comprising an amino acid sequence selected from the group consisting of SEQ ID NOs: 678-682; and (f) variable light chain complementarity determining region 3 (VL CDR3) comprising an amino acid sequence selected from the group consisting of SEQ ID NOs: 683-687

In some embodiments, at least one arm of the multispecific antibody, e.g., a bispecific antibody, includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664).

In some embodiments, at least one arm of the multispecific antibody, e.g., a bispecific antibody, includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, at least one arm of the multispecific antibody, e.g., a bispecific antibody, includes a combination of a VL CDR1 sequence, a VL CDR2 sequence, and a VL CDR3 sequence, wherein the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, at least one arm of the multispecific antibody, e.g., a bispecific antibody, includes a combination of a VL CDR1 sequence, a VL CDR2 sequence, and a VL CDR3 sequence, wherein the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, at least one arm of the multispecific antibody, e.g., a bispecific antibody, includes a heavy chain that comprises or is derived from the amino acid sequence of SEQ ID NO: 1346, and a light chain that comprises or is derived from the amino acid sequence of SEQ ID NO: 626.

In some embodiments, at least one arm of the multispecific antibody, e.g., a bispecific antibody, includes a heavy chain that comprises or is derived from the amino acid sequence of SEQ ID NO: 1514, and a light chain that comprises or is derived from the amino acid sequence of SEQ ID NO: 638.

In some embodiments, at least one arm of the multispecific antibody, e.g., a bispecific antibody, includes the combination of the complementarity determining region (CDR) sequences of the heavy chain amino acid sequence of SEQ ID NO: 1346. In some embodiments, at least one arm of the multispecific antibody, e.g., a bispecific antibody, includes the combination of the CDR sequences of the light chain amino acid sequence of SEQ ID NO: 626. In some embodiments, at least one arm of the multispecific antibody, e.g., a bispecific antibody, includes a combination of the CDR sequences of the heavy chain amino acid sequence of SEQ ID NO: 1346, and the CDR sequences of the light chain amino acid sequence of SEQ ID NO: 626.

In some embodiments, at least one arm of the multispecific antibody, e.g., a bispecific antibody, includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GITFSNSG (SEQ ID NO: 1705); the VH CDR2 sequence comprises IWYDGSKR (SEQ ID NO: 1706); and the VH CDR3 sequence comprises TNDDY (SEQ ID NO: 1707).

In some embodiments, at least one arm of the multispecific antibody, e.g., a bispecific antibody, includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GITFSNSG (SEQ ID NO: 1705); the VH CDR2 sequence comprises IWYDGSKR (SEQ ID NO: 1706); the VH CDR3 sequence comprises TNDDY (SEQ ID NO: 1707); the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, at least one arm of the multispecific antibody, e.g., a bispecific antibody, includes the combination of the complementarity determining region (CDR) sequences of the heavy chain amino acid sequence of SEQ ID NO: 1514. In some embodiments, at least one arm of the multispecific antibody, e.g., a bispecific antibody, includes the combination of the CDR sequences of the light chain amino acid sequence of SEQ ID NO: 638. In some embodiments, at least one arm of the multispecific antibody, e.g., a bispecific antibody, includes a combination of the CDR sequences of the heavy chain amino acid sequence of SEQ ID NO: 1514, and the CDR sequences of the light chain amino acid sequence of SEQ ID NO: 638.

In some embodiments, at least one arm of the multispecific antibody, e.g., a bispecific antibody, includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GYTFTNYY (SEQ ID NO: 1711); the VH CDR2 sequence comprises INPSNGGT (SEQ ID NO: 1712); and the VH CDR3 sequence comprises RRDYRFDMGFDY (SEQ ID NO: 1713).

In some embodiments, at least one arm of the multispecific antibody, e.g., a bispecific antibody, includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GYTFTNYY (SEQ ID NO: 1711); the VH CDR2 sequence comprises INPSNGGT (SEQ ID NO: 1712); the VH CDR3 sequence comprises RRDYRFDMGFDY (SEQ ID NO: 1713); the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37. In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37.

In some embodiments, at least one arm of the multispecific antibody, e.g., a bispecific antibody, comprises a light chain amino acid that is at least 90%, 91%, 92%, 93%, 94%, 95%, 96%, 97%, 98% or 99% identical to an amino acid sequence selected from the group consisting of SEQ ID NO: 3, 7, 11, 15, 19, 39, 41, 43, 45, 47, 49, 51, 53, 55, 57, and 59. In some embodiments, at least one arm of the multispecific antibody, e.g., a bispecific antibody, comprises a light chain amino acid that is at least 90%, 91%, 92%, 93%, 94%, 95%, 96%, 97%, 98% or 99% identical to an amino acid sequence selected from the group consisting of SEQ ID NO: 39, 41, 43, 45, 47, 49, 51, 53, 55, 57, and 59.

In some embodiments, at least one arm of the multispecific antibody, e.g., a bispecific antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence selected from the group consisting of SEQ ID NO: 3, 7, 11, 15, 19, 39, 41, 43, 45, 47, 49, 51, 53, 55, 57, and 59.

In some embodiments, at least one arm of the multispecific antibody, e.g., a bispecific antibody, includes a heavy chain amino acid sequence that is at least 90%, 91%, 92%, 93%, 94%, 95%, 96%, 97%, 98% or 99% identical to the amino acid sequence of SEQ ID NO: 1346, and a light chain amino acid that is at least 90%, 91%, 92%, 93%, 94%, 95%, 96%, 97%, 98% or 99% identical to the amino acid sequence of SEQ ID NO: 626.

In some embodiments, at least one arm of the multispecific antibody, e.g., a bispecific antibody, includes a heavy chain amino acid sequence that is at least 90%, 91%, 92%, 93%, 94%, 95%, 96%, 97%, 98% or 99% identical to the amino acid sequence of SEQ ID NO: 1514, and a light chain amino acid that is at least 90%, 91%, 92%, 93%, 94%, 95%, 96%, 97%, 98% or 99% identical to the amino acid sequence of SEQ ID NO: 638.

In some embodiments, at least one arm of the multispecific antibody, e.g., a bispecific antibody, includes a combination of a VH CDR1 sequence, a VH CDR2 sequence, and a VH CDR3 sequence, wherein the VH CDR1 sequence comprises a sequence that is at least 90%, 91%, 92%, 93%, 94%, 95%, 96%, 97%, 98%, 99% or more identical to GITFSNSG (SEQ ID NO: 1705); the VH CDR2 sequence comprises a sequence that is at least 90%, 91%, 92%, 93%, 94%, 95%, 96%, 97%, 98%, 99% or more identical to IWYDGSKR (SEQ ID NO: 1706); and the VH CDR3 sequence comprises a sequence that is at least 90%, 91%, 92%, 93%, 94%, 95%, 96%, 97%, 98%, 99% or more identical to TNDDY (SEQ ID NO: 1707).

In some embodiments, at least one arm of the multispecific antibody, e.g., a bispecific antibody, includes a combination of a VL CDR1 sequence, a VL CDR2 sequence, and a VL CDR3 sequence, wherein the VL CDR1 sequence comprises a sequence that is at least 90%, 91%, 92%, 93%, 94%, 95%, 96%, 97%, 98%, 99% or more identical to QSVSSY (SEQ ID NO: 1708); the VL CDR2 sequence comprises a sequence that is at least 90%, 91%, 92%, 93%, 94%, 95%, 96%, 97%, 98%, 99% or more identical to DAS (SEQ ID NO: 1709); and the VL CDR3 sequence comprises a sequence that is at least 90%, 91%, 92%, 93%, 94%, 95%, 96%, 97%, 98%, 99% or more identical to QQSSNWPRT (SEQ ID NO: 1710).

In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to GITFSNSG (SEQ ID NO: 1705); the VH CDR2 sequence comprises a sequence that is at least 90%, 91%, 92%, 93%, 94%, 95%, 96%, 97%, 98%, 99% or more identical to IWYDGSKR (SEQ ID NO: 1706); the VH CDR3 sequence comprises a sequence that is at least 90%, 91%, 92%, 93%, 94%, 95%, 96%, 97%, 98%, 99% or more identical to TNDDY (SEQ ID NO: 1707); the VL CDR1 sequence comprises a sequence that is at least 90%, 91%, 92%, 93%, 94%, 95%, 96%, 97%, 98%, 99% or more identical to QSVSSY (SEQ ID NO: 1708); the VL CDR2 sequence comprises a sequence that is at least 90%, 91%, 92%, 93%, 94%, 95%, 96%, 97%, 98%, 99% or more identical to DAS (SEQ ID NO: 1709); and the VL CDR3 sequence comprises a sequence that is at least 90%, 91%, 92%, 93%, 94%, 95%, 96%, 97%, 98%, 99% or more identical to QQSSNWPRT (SEQ ID NO: 1710).

In some embodiments, at least one arm of the multispecific antibody, e.g., a bispecific antibody, includes a combination of a VH CDR1 sequence, a VH CDR2 sequence, and a VH CDR3 sequence, wherein the VH CDR1 sequence comprises a sequence that is at least 90%, 91%, 92%, 93%, 94%, 95%, 96%, 97%, 98%, 99% or more identical to GYTFTNYY (SEQ ID NO: 1711); the VH CDR2 sequence comprises a sequence that is at least 90%, 91%, 92%, 93%, 94%, 95%, 96%, 97%, 98%, 99% or more identical to INPSNGGT (SEQ ID NO: 1712); and the VH CDR3 sequence comprises a sequence that is at least 90%, 91%, 92%, 93%, 94%, 95%, 96%, 97%, 98%, 99% or more identical to RRDYRFDMGFDY (SEQ ID NO: 1713).

In some embodiments, at least one arm of the multispecific antibody, e.g., a bispecific antibody, includes a combination of a VL CDR1 sequence, a VL CDR2 sequence, and a VL CDR3 sequence, wherein the VL CDR1 sequence comprises a sequence that is at least 90%, 91%, 92%, 93%, 94%, 95%, 96%, 97%, 98%, 99% or more identical to KGVSTSGYSY (SEQ ID NO: 1714); the VL CDR2 sequence comprises a sequence that is at least 90%, 91%, 92%, 93%, 94%, 95%, 96%, 97%, 98%, 99% or more identical to LAS (SEQ ID NO: 1715); and the VL CDR3 sequence comprises a sequence that is at least 90%, 91%, 92%, 93%, 94%, 95%, 96%, 97%, 98%, 99% or more identical to QHSRDLPLT (SEQ ID NO: 1716).

In some embodiments, at least one arm of the multispecific antibody, e.g., a bispecific antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to GYTFTNYY (SEQ ID NO: 1711); the VH CDR2 sequence comprises a sequence that is at least 90%, 91%, 92%, 93%, 94%, 95%, 96%, 97%, 98%, 99% or more identical to INPSNGGT (SEQ ID NO: 1712); the VH CDR3 sequence comprises a sequence that is at least 90%, 91%, 92%, 93%, 94%, 95%, 96%, 97%, 98%, 99% or more identical to RRDYRFDMGFDY (SEQ ID NO: 1713); the VL CDR1 sequence comprises a sequence that is at least 90%, 91%, 92%, 93%, 94%, 95%, 96%, 97%, 98%, 99% or more identical to KGVSTSGYSY (SEQ ID NO: 1714); the VL CDR2 sequence comprises a sequence that is at least 90%, 91%, 92%, 93%, 94%, 95%, 96%, 97%, 98%, 99% or more identical to LAS (SEQ ID NO: 1715); and the VL CDR3 sequence comprises a sequence that is at least 90%, 91%, 92%, 93%, 94%, 95%, 96%, 97%, 98%, 99% or more identical to QHSRDLPLT (SEQ ID NO: 1716).

In some embodiments, at least one arm of the multispecific antibody, e.g., a bispecific antibody, comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 8; a VH CDR2 sequence shown in Table 8; a VH CDR3 sequence shown in Table 8; a VL CDR1 sequence shown in Table 8; a VL CDR2 sequence shown in Table 8; and a VL CDR3 sequence shown in Table 8.

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 8; a VH CD2 sequence that includes a sequence that is at least 90%, 91%, 92%, 93%, 94%, 95%, 96%, 97%, 98%, 99% or more identical to a VH CDR2 sequence shown in Table 8; a VH CDR3 sequence that includes a sequence that is at least 90%, 91%, 92%, 93%, 94%, 95%, 96%, 97%, 98%, 99% or more identical to a VH CDR3 sequence shown in Table 8; a VL CDR1 sequence that includes a sequence that is at least 90%, 91%, 92%, 93%, 94%, 95%, 96%, 97%, 98%, 99% or more identical to a VL CDR1 sequence shown in Table 8; a VL CDR2 sequence that includes a sequence that is at least 90%, 91%, 92%, 93%, 94%, 95%, 96%, 97%, 98%, 99% or more identical to a VL CDR2 sequence shown in Table 8; and a VL CDR3 sequence that includes a sequence that is at least 90%, 91%, 92%, 93%, 94%, 95%, 96%, 97%, 98%, 99% or more identical to a VL CDR3 sequence shown in Table 8.

In some embodiments, at least one arm of the multispecific antibody, e.g., a bispecific antibody, comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination of the six CDR sequences (VH CDR1, VH CDR2, VH CDR3, VL CDR1, VL CDR2, and VL CDR3) shown in a single row in Table 8.

In some embodiments, at least one arm of the multispecific antibody, e.g., a bispecific antibody, comprises a heavy chain that comprises a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 8.

In some embodiments, at least one arm of the multispecific antibody, e.g., a bispecific antibody, comprises a combination of a VH CDR1 sequence, a VH CDR2 sequence, a VH CDR3 sequence shown in a single row in Table 8, a VL CDR1 sequence, a VL CDR2 sequence, and a VL CDR3 sequence shown in a single row in Table 8, wherein each CDR sequence in the combination comprises a sequence that is at least 90%, 91%, 92%, 93%, 94%, 95%, 96%, 97%, 98%, 99% or more identical to the corresponding VH CDR sequence shown in a single row in Table 8 and the corresponding VL CDR shown in a single row in Table 8.

In some embodiments, at least one arm of the multispecific antibody, e.g., a bispecific antibody, comprises a heavy chain that comprises a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 8.

The disclosure also provides activatable antibodies that include an antibody or antigen-binding fragment thereof that specifically binds PD-1 coupled to a masking moiety (MM), such that coupling of the MM reduces the ability of the antibody or antigen-binding fragment thereof to bind PD-1. In some embodiments, the MM is coupled via a cleavable moiety (CM) that includes sequence that functions as a substrate for a protease. The activatable anti-PD-1 antibodies of the disclosure are activated when the cleavable moiety is cleaved by a protease. For example, the protease is produced by a tumor that is in proximity to T cells that express PD-1. In some embodiments, the protease is produced by a tumor that is co-localized with T cells that express PD-1.

The activatable anti-PD-1 antibodies provided herein, also referred to herein as anti-PD-1 activatable antibodies or PD-1 activatable antibodies, are stable in circulation, activated at intended sites of therapy and/or diagnosis but not in normal, e.g., healthy tissue or other tissue not targeted for treatment and/or diagnosis, and, when activated, exhibit binding to PD-1 that is at least comparable to the corresponding, unmodified antibody.

The invention also provides methods of treating, preventing and/or delaying the onset or progression of, or alleviating a symptom associated with aberrant expression and/or activity of PD-1 in a subject using antibodies or activatable antibodies that bind PD-1, particularly activatable antibodies that bind and neutralize or otherwise inhibit at least one biological activity of PD-1.

In some embodiments, the activatable anti-PD-1 antibody comprises an activatable antibody that, in an activated state, specifically binds to mammalian PD-1, wherein said activatable antibody comprises: an antibody or an antigen binding fragment thereof (AB) that specifically binds to mammalian PD-1; a masking moiety (MM) that inhibits the binding of the AB to mammalian PD-1 when the activatable antibody is in an uncleaved state; and a cleavable moiety (CM) coupled to the AB, wherein the CM is a polypeptide that functions as a substrate for a protease.

In some embodiments, the activatable anti-PD-1 antibody comprises an activatable antibody that, in an activated state, (a) specifically binds to mammalian PD-1; and (b) specifically blocks a natural ligand of PD-1 from binding to the mammalian PD-1, wherein the activatable antibody comprises: an antibody or an antigen binding fragment thereof (AB) that specifically binds to mammalian PD-1; a masking moiety (MM) that inhibits the binding of the AB to mammalian PD-1 when the activatable antibody is in an uncleaved state; and a cleavable moiety (CM) coupled to the AB, wherein the CM is a polypeptide that functions as a substrate for a protease.

In some embodiments, the activatable antibody in an uncleaved state specifically binds to the mammalian PD-1 with a dissociation constant of 0.5 nM to 1 nM, 0.5 nM to 2 nM, 0.5 nM to 5 nM, 0.5 nM to 10 nM, 0.5 nM to 15 nM, 0.5 nM to 20 nM, 0.5 nM to 25 nM, 0.5 nM to 50 nM, 0.5 nM to 75 nM, 0.5 nM to 100 nM, 0.5 nM to 150 nM, 0.5 nM to 200 nM, 0.5 nM to 300 nM, 0.5 nM to 400 nM, 1 nM to 2 nM, 1 nM to 5 nM, 1 nM to 10 nM, 1 nM to 15 nM, 1 nM to 20 nM, 1 nM to 25 nM, 1 nM to 50 nM, 1 nM to 75 nM, 1 nM to 100 nM, 1 nM to 150 nM, 1 nM to 200 nM, 1 nM to 300 nM, 1 nM to 400 nM, 2 nM to 5 nM, 2 nM to 10 nM, 2 nM to 15 nM, 2 nM to 20 nM, 2 nM to 25 nM, 2 nM to 50 nM, 2 nM to 75 nM, 2 nM to 100 nM, 2 nM to 150 nM, 2 nM to 200 nM, 2 nM to 300 nM, 2 nM to 400 nM, 5 nM to 10 nM, 5 nM to 15 nM, 5 nM to 20 nM, 5 nM to 25 nM, 5 nM to 50 nM, 5 nM to 75 nM, 5 nM to 100 nM, 5 nM to 150 nM, 5 nM to 200 nM, 5 nM to 300 nM, 5 nM to 400 nM, 10 nM to 15 nM, 10 nM to 20 nM, 10 nM to 25 nM, 10 nM to 50 nM, 10 nM to 75 nM, 10 nM to 100 nM, 10 nM to 150 nM, 10 nM to 200 nM, 10 nM to 300 nM, 10 nM to 400 nM, 15 nM to 20 nM, 15 nM to 25 nM, 15 nM to 50 nM, 15 nM to 75 nM, 15 nM to 100 nM, 15 nM to 150 nM, 15 nM to 200 nM, 15 nM to 300 nM, 15 nM to 400 nM, 20 nM to 25 nM, 20 nM to 50 nM, 20 nM to 75 nM, 20 nM to 100 nM, 20 nM to 150 nM, 20 nM to 200 nM, 20 nM to 300 nM, 20 nM to 400 nM, 25 nM to 50 nM, 25 nM to 75 nM, 25 nM to 100 nM, 25 nM to 150 nM, 25 nM to 200 nM, 25 nM to 300 nM, 25 nM to 400 nM, 50 nM to 75 nM, 50 nM to 100 nM, 50 nM to 150 nM, 50 nM to 200 nM, 50 nM to 300 nM, 50 nM to 400 nM, 75 nM to 100 nM, 75 nM to 150 nM, 75 nM to 200 nM, 75 nM to 300 nM, 75 nM to 400 nM, 100 nM to 150 nM, 100 nM to 200 nM, 100 nM to 300 nM, 100 nM to 400 nM, 150 nM to 200 nM, 150 nM to 300 nM, 150 nM to 400 nM, 200 nM to 300 nM, 200 nM to 400 nM, or 300 nM to 400 nM.

In some embodiments, the activatable antibody in an activated state specifically binds to the mammalian PD-1 with a dissociation constant of 0.01 nM to 5 nM, 0.05 nM to 5 nM, 0.1 nM to 5 nM, 0.2 nM to 5 nM, 0.3 nM to 5 nM, 0.4 nM to 5 nM, 0.5 nM to 5 nM, 0.75 nM to 5 nM, 1 nM to 5 nM, 2 nM to 5 nM, 0.01 nM to 2 nM, 0.05 nM to 2 nM, 0.1 nM to 2 nM, 0.2 nM to 2 nM, 0.3 nM to 2 nM, 0.4 nM to 2 nM, 0.5 nM to 2 nM, 0.75 nM to 1 nM, 1 nM to 2 nM, 0.01 nM to 1 nM, 0.05 nM to 1 nM, 0.1 nM to 1 nM, 0.2 nM to 1 nM, 0.3 nM to 1 nM, 0.4 nM to 1 nM, 0.5 nM to 1 nM, 0.75 nM to 1 nM, 0.01 nM to 0.75 nM, 0.05 nM to 0.75 nM, 0.1 nM to 0.75 nM, 0.2 nM to 0.75 nM, 0.3 nM to 0.75 nM, 0.4 nM to 0.75 nM, 0.5 nM to 0.75 nM, 0.01 nM to 0.5 nM, 0.05 nM to 0.5 nM, 0.1 nM to 0.5 nM, 0.2 nM to 0.5 nM, 0.3 nM to 0.5 nM, 0.4 nM to 0.5 nM, 0.01 nM to 0.4 nM, 0.05 nM to 0.4 nM, 0.1 nM to 0.4 nM, 0.2 nM to 0.4 nM, 0.3 nM to 0.4 nM, 0.01 nM to 0.3 nM, 0.05 nM to 0.3 nM, 0.1 nM to 0.3 nM, 0.2 nM to 0.3 nM, 0.01 nM to 0.2 nM, 0.05 nM to 0.2 nM, 0.1 nM to 0.2 nM, 0.01 nM to 0.1 nM, 0.05 nM to 0.1 nM, or 0.01 nM to 0.05 nM.

In some embodiments, the activatable antibody comprises an AB that specifically binds to the mammalian PD-1 with a dissociation constant of 0.01 nM to 5 nM, 0.05 nM to 5 nM, 0.1 nM to 5 nM, 0.2 nM to 5 nM, 0.3 nM to 5 nM, 0.4 nM to 5 nM, 0.5 nM to 5 nM, 0.75 nM to 5 nM, 1 nM to 5 nM, 2 nM to 5 nM, 0.01 nM to 2 nM, 0.05 nM to 2 nM, 0.1 nM to 2 nM, 0.2 nM to 2 nM, 0.3 nM to 2 nM, 0.4 nM to 2 nM, 0.5 nM to 2 nM, 0.75 nM to 1 nM, 1 nM to 2 nM, 0.01 nM to 1 nM, 0.05 nM to 1 nM, 0.1 nM to 1 nM, 0.2 nM to 1 nM, 0.3 nM to 1 nM, 0.4 nM to 1 nM, 0.5 nM to 1 nM, 0.75 nM to 1 nM, 0.01 nM to 0.75 nM, 0.05 nM to 0.75 nM, 0.1 nM to 0.75 nM, 0.2 nM to 0.75 nM, 0.3 nM to 0.75 nM, 0.4 nM to 0.75 nM, 0.5 nM to 0.75 nM, 0.01 nM to 0.5 nM, 0.05 nM to 0.5 nM, 0.1 nM to 0.5 nM, 0.2 nM to 0.5 nM, 0.3 nM to 0.5 nM, 0.4 nM to 0.5 nM, 0.01 nM to 0.4 nM, 0.05 nM to 0.4 nM, 0.1 nM to 0.4 nM, 0.2 nM to 0.4 nM, 0.3 nM to 0.4 nM, 0.01 nM to 0.3 nM, 0.05 nM to 0.3 nM, 0.1 nM to 0.3 nM, 0.2 nM to 0.3 nM, 0.01 nM to 0.2 nM, 0.05 nM to 0.2 nM, 0.1 nM to 0.2 nM, 0.01 nM to 0.1 nM, 0.05 nM to 0.1 nM, or 0.01 nM to 0.05 nM.

In some embodiments, the mammalian PD-1 is selected from the group consisting of a human PD-1 and a cynomolgus monkey PD-1. In some embodiments, the AB specifically binds to human PD-1 or cynomolgus monkey PD-1 with a dissociation constant of less than or equal to 1 nM. In some embodiments, the mammalian PD-1 is a human PD-1. In some embodiments, the AB has one or more of the characteristics selected from the group consisting of: (a) the AB specifically binds human PD-1 and cynomolgus monkey PD-1; (b) the AB inhibits binding of human PDL1 and human PDL2 to human PD-1; and (c) the AB inhibits binding of cynomolgus monkey PDL1 and cynomolgus monkey PDL2 to cynomolgus monkey PD-1.

In some embodiments, the mammalian PD-1 is mouse PD-1. In some embodiments, the activatable antibody comprises an AB that specifically binds mouse PD-1 or inhibits binding of mouse PDL1 and mouse PDL2 to mouse PD1.

In some embodiments, the activatable antibody in an uncleaved state specifically binds to the mammalian PD-1 with a dissociation constant greater than or equal to 0.5 nM, greater than or equal to 1 nM, greater than or equal to 2 nM, greater than or equal to 3 nM, greater than or equal to 4 nM, greater than or equal to 5 nM, greater than or equal to 10 nM, greater than or equal to 15 nM, greater than or equal to 20 nM, greater than or equal to 25 nM, greater than or equal to 50 nM, greater than or equal to 75 nM, greater than or equal to 100 nM, greater than or equal to 150 nM, greater than or equal to 200 nM, greater than or equal to 300 nM and/or greater than or equal to 400 nM.

In some embodiments, the activatable antibody in an activated state specifically binds to the mammalian PD-1 with a dissociation constant less than or equal to 0.01 nM, less than or equal to 0.05 nM, less than or equal to 0.1 nM, less than or equal to 0.2 nM, less than or equal to 0.3 nM, less than or equal to 0.4 nM, less than or equal to 0.5 nM, less than or equal to 0.75 nM, and less than or equal to 1 nM.

In some embodiments, the activatable antibody comprises an AB that specifically binds to the mammalian PD-1 with a dissociation constant less than or equal to 0.01 nM, less than or equal to 0.05 nM, less than or equal to 0.1 nM, less than or equal to 0.2 nM, less than or equal to 0.3 nM, less than or equal to 0.4 nM, less than or equal to 0.5 nM, less than or equal to 0.75 nM, and less than or equal to 1 nM.

In some embodiments, the activatable antibody comprises an AB blocks the ability of a natural ligand to bind to the mammalian PDL1 with an $EC_{50}$ of 0.1 nM to 10 nM, 0.1 nM to 5 nM, 0.1 nM to 3 nM, 0.1 nM to 2 nM, 0.1 nM to 1 nM, 0.1 nM to 0.5 nM, 0.1 nM to 0.25 nM, 0.25 nM to 10 nM, 0.25 nM to 5 nM, 0.25 nM to 3 nM, 0.25 nM to 2 nM, 0.25 nM to 1 nM, 0.25 nM to 0.5 nM, 0.5 nM to 10 nM, 0.5 nM to 5 nM, 0.5 nM to 3 nM, 0.5 nM to 2 nM, 0.5 nM to 1 nM, 1 nM to 10 nM, 1 nM to 5 nM, 1 nM to 3 nM, 1 nM to 2 nM, 2 nM to 10 nM, 2 nM to 5 nM, 2 nM to 3 nM, 3 nM to 10 nM, 3 nM to 5 nM, or 5 nM to 10 nM.

In some embodiments, the natural ligand is a mammalian PDL1 or a mammalian PDL2. In some embodiments, the natural ligand is selected from the group consisting of: a human PDL1, a human PDL2, a cynomolgus monkey PDL1, and a cynomolgus monkey PDL2.

In some embodiments, the activatable antibody has one or more of the following characteristics: (a) the AB induces type 1 diabetes in a non-obese diabetic (NOD) mouse; and (b) the activatable antibody in an uncleaved state inhibits the induction of type 1 diabetes in a NOD mouse.

In some embodiments, the activatable antibody inhibits the induction of type 1 diabetes in the NOD mouse after administration of the activatable antibody at a single dose of 0.5 mg/kg to 15 mg/kg, 1 mg/kg to 15 mg/kg, 2 mg/kg to 15 mg/kg, 3 mg/kg to 15 mg/kg, 5 mg/kg to 15 mg/kg, 10 mg/kg to 15 mg/kg, 0.5 mg/kg to 10 mg/kg, 1 mg/kg to 10 mg/kg, 2 mg/kg to 10 mg/kg, 3 mg/kg to 10 mg/kg, 5 mg/kg to 10 mg/kg, 0.5 mg/kg to 5 mg/kg, 1 mg/kg to 5 mg/kg, 2 mg/kg to 5 mg/kg, 3 mg/kg to 5 mg/kg, 0.5 mg/kg to 3 mg/kg, 1 mg/kg to 3 mg/kg, 2 mg/kg to 3 mg/kg, 0.5 mg/kg to 2 mg/kg, 1 mg/kg to 2 mg/kg, or 0.5 mg/kg to 1 mg/kg. In some embodiments, the activatable antibody inhibits the induction of type 1 diabetes in the NOD mouse after administration of the activatable antibody at a single dose of 3 mg/kg to 10 mg/kg, 3 mg/kg or 10 mg/kg. In some embodiments, the activatable antibody inhibits the induction of type 1 diabetes in the NOD mouse after administration of the activatable antibody at a single dose of 3 mg/kg to 10 mg/kg. In some embodiments, the activatable antibody inhibits the induction of type 1 diabetes in the NOD mouse after administration of the activatable antibody at a single dose of 3 mg/kg. In some embodiments, the activatable antibody inhibits the induction of type 1 diabetes in the NOD mouse after administration of the activatable antibody at a single dose of 10 mg/kg.

In some embodiments, the AB induces type 1 diabetes in the NOD mouse after administration of the AB at a single dose of 0.5 mg/kg to 15 mg/kg, 1 mg/kg to 15 mg/kg, 2 mg/kg to 15 mg/kg, 3 mg/kg to 15 mg/kg, 5 mg/kg to 15 mg/kg, 10 mg/kg to 15 mg/kg, 0.5 mg/kg to 10 mg/kg, 1 mg/kg to 10 mg/kg, 2 mg/kg to 10 mg/kg, 3 mg/kg to 10 mg/kg, 5 mg/kg to 10 mg/kg, 0.5 mg/kg to 5 mg/kg, 1 mg/kg to 5 mg/kg, 2 mg/kg to 5 mg/kg, 3 mg/kg to 5 mg/kg, 0.5 mg/kg to 3 mg/kg, 1 mg/kg to 3 mg/kg, 2 mg/kg to 3 mg/kg, 0.5 mg/kg to 2 mg/kg, 1 mg/kg to 2 mg/kg, or 0.5 mg/kg to 1 mg/kg. In some embodiments, the AB induces type 1 diabetes in the NOD mouse after administration of the AB at a single dose of 1 mg/kg to 20 mg/kg, 1 mg/kg, 3 mg/kg, 5 mg/kg, 10 mg/kg, or 20 mg/kg. In some embodiments, the AB induces type 1 diabetes in the NOD mouse after administration of the AB at a single dose of 1 mg/kg to 20 mg/kg. In some embodiments, the AB induces type 1 diabetes in the NOD mouse after administration of the AB at a single dose of 1 mg/kg. In some embodiments, the AB induces type 1 diabetes in the NOD mouse after administration of the AB at a single dose of 3 mg/kg. In some embodiments, the AB induces type 1 diabetes in the NOD mouse after administration of the AB at a single dose of 5 mg/kg. In some embodiments, the AB induces type 1 diabetes in the NOD mouse after administration of the AB at a single dose of 10 mg/kg. In some embodiments, the AB induces type 1 diabetes in the NOD mouse after administration of the AB at a single dose of 20 mg/kg.

In some embodiments, the activatable antibody has one or more of the following characteristics: (a) the activatable antibody in an uncleaved state does not induce type 1 diabetes in greater than 50% of a population of non-obese diabetic (NOD) mice, and (b) the AB induces type 1 diabetes in greater than 50%, greater than 60%, greater than 70%, greater than 80%, between 50% to 100%, between 50% and 75%, or between 70% and 90% of a population of NOD mice.

In some embodiments, the activatable antibody does not induce type 1 diabetes in greater than 50%, greater than 60%, greater than 70%, greater than 80%, between 50% to 100%, between 50% and 75%, or between 70% and 90% of the population of NOD mice after administration to each mouse in the population a single dose of the activatable antibody at a dosage of: 0.5 mg/kg to 15 mg/kg, 1 mg/kg to 15 mg/kg, 2 mg/kg to 15 mg/kg, 3 mg/kg to 15 mg/kg, 5 mg/kg to 15 mg/kg, 10 mg/kg to 15 mg/kg, 0.5 mg/kg to 10 mg/kg, 1 mg/kg to 10 mg/kg, 2 mg/kg to 10 mg/kg, 3 mg/kg to 10 mg/kg, 5 mg/kg to 10 mg/kg, 0.5 mg/kg to 5 mg/kg, 1 mg/kg to 5 mg/kg, 2 mg/kg to 5 mg/kg, 3 mg/kg to 5 mg/kg, 0.5 mg/kg to 3 mg/kg, 1 mg/kg to 3 mg/kg, 2 mg/kg to 3 mg/kg, 0.5 mg/kg to 2 mg/kg, 1 mg/kg to 2 mg/kg, or 0.5 mg/kg to 1 mg/kg. In some embodiments, the activatable antibody inhibits the induction of type 1 diabetes in the NOD mouse after administration of the activatable antibody at a single dose of 3 mg/kg to 10 mg/kg, 3 mg/kg or 10 mg/kg. In some embodiments the dose is a single dose of 3 mg/kg to 10 mg/kg. In some embodiments the dose is a single dose of 3 mg/kg. In some embodiments the dose is a single dose of 10 mg/kg.

In some embodiments, the activatable antibody has one or more of the following characteristics: (a) the activatable antibody in an uncleaved state does not induce type 1 diabetes in greater than 50%, greater than 60%, greater than 70%, greater than 80%, between 50% to 100%, between 50% and 75%, or between 70% and 90% of a population of non-obese diabetic (NOD) mice when administered at a single dose of 3 mg/kg; and (b) the AB induces type 1 diabetes in greater than 50%, greater than 60%, greater than 70%, greater than 80%, between 50% to 100%, between 50% and 75%, or between 70% and 90% of a population of NOD mice, when administered at a single dose of 3 mg/kg.

In some embodiments, the activatable antibody has one or more of the following characteristics: (a) the activatable antibody in an uncleaved state does not induce type 1 diabetes in greater than 50%, greater than 60%, greater than 70%, greater than 80%, between 50% to 100%, between 50% and 75%, or between 70% and 90% of a population of non-obese diabetic (NOD) mice when administered at a single dose of 10 mg/kg; and (b) the AB induces type 1 diabetes in greater than 50%, greater than 60%, greater than 70%, greater than 80%, between 50% to 100%, between 50% and 75%, or between 70% and 90% of a population of NOD mice, when administered at a single dose of 10 mg/kg.

In some embodiments, the AB induces type 1 diabetes in greater than 50%, greater than 60%, greater than 70%, greater than 80%, between 50% to 100%, between 50% and 75%, or between 70% and 90% of the population of the NOD mice after administration to each mouse in the population a single dose of the AB at a dosage of: 2 mg/kg to 15 mg/kg, 3 mg/kg to 15 mg/kg, 5 mg/kg to 15 mg/kg, 10 mg/kg to 15 mg/kg, 2 mg/kg to 10 mg/kg, 3 mg/kg to 10 mg/kg, 5 mg/kg to 10 mg/kg, 2 mg/kg to 5 mg/kg, 3 mg/kg to 5 mg/kg, or 2 mg/kg to 3 mg/kg. In some embodiments the dose is a single dose of 3 mg/kg to 20 mg/kg, 3 mg/kg, 5 mg/kg, 10 mg/kg, or 20 mg/kg. In some embodiments the dose is a single dose of 3 mg/kg to 20 mg/kg. In some embodiments the dose is a single dose of 3 mg/kg. In some embodiments the dose is a single dose of 5 mg/kg. In some embodiments the dose is a single dose of 10 mg/kg. In some embodiments the dose is a single dose of 20 mg/kg.

In some embodiments, the activatable antibody in an uncleaved state does not induce type 1 diabetes in greater than 50% of a population of non-obese diabetic (NOD) mice, wherein the population of NOD mice are concurrently dosed with an anti-CTLA4 antibody.

In some embodiments, the population of NOD mice are each administered a single dose of the activatable antibody at a dosage of 2 mg/kg to 15 mg/kg, 3 mg/kg to 15 mg/kg, 5 mg/kg to 15 mg/kg, 10 mg/kg to 15 mg/kg, 2 mg/kg to 10 mg/kg, 3 mg/kg to 10 mg/kg, 5 mg/kg to 10 mg/kg, 2 mg/kg to 5 mg/kg, 3 mg/kg to 5 mg/kg, or 2 mg/kg to 3 mg/kg concurrently with a dose of an anti-CTLA4 antibody. In some embodiments, the population of NOD mice are each administered a single dose of the activatable antibody at a dosage of 10 mg/kg concurrently with a dose of an anti-CTLA4 antibody.

In some embodiments, the population of NOD mice is each administered a single dose of the anti-CTLA4 antibody at a dosage of 2 mg/kg to 15 mg/kg, 3 mg/kg to 15 mg/kg, 5 mg/kg to 15 mg/kg, or 10 mg/kg to 15 mg/kg concurrently with a dose of an anti-PD-1 activatable antibody. In some embodiments, the population of NOD mice is each administered a single dose of the anti-CTLA4 antibody at a dosage of 10 mg/kg concurrently with a dose of an anti-PD-1 activatable antibody.

In some embodiments, the population of NOD mice is each administered a single dose of the activatable antibody at a dosage of 5 mg/kg to 15 mg/kg and a single dose of the anti-CTLA4 antibody at a dosage of 5 mg/kg to 15 mg/kg. In some embodiments, the population of NOD mice is each administered a single dose of the activatable antibody at a dosage of 10 mg/kg concurrently with a single dose of an anti-CTLA4 antibody at a dosage of 10 mg/kg.

In some embodiments, the NOD mouse is a female NOD/ShiLtJ mouse substrain. In some embodiments, the population of NOD mice is each 5 weeks old when the activatable antibody is first administered. In some embodiments, the population of NOD mice is each 10 weeks old when the activatable antibody is first administered.

The activatable antibodies in an activated state bind PD-1 and include (i) an antibody or an antigen binding fragment thereof (AB) that specifically binds to PD-1; (ii) a masking moiety (MM) that, when the activatable antibody is in an uncleaved state, inhibits the binding of the AB to PD-1; and (c) a cleavable moiety (CM) coupled to the AB, wherein the CM is a polypeptide that functions as a substrate for a protease.

In some embodiments, the activatable antibody in the uncleaved state has the structural arrangement from N-terminus to C-terminus as follows: MM-CM-AB or AB-CM-MM.

In some embodiments, the activatable antibody comprises a linking peptide between the MM and the CM.

In some embodiments, the activatable antibody comprises a linking peptide between the CM and the AB.

In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the two linking peptides need not be identical to each other. In some embodiments, each of LP1 and LP2 is a peptide of about 1 to 20 amino acids in length.

In some embodiments, at least one of LP1 or LP2 comprises an amino acid sequence selected from the group consisting of $(GS)_n$, $(GGS)_n$, $(GSGGS)_n$ (SEQ ID NO: 363) and $(GGGS)_n$ (SEQ ID NO: 364), where n is an integer of at least one.

In some embodiments, at least one of LP1 or LP2 comprises an amino acid sequence selected from the group consisting of GGSG (SEQ ID NO: 365), GGSGG (SEQ ID NO: 366), GSGSG (SEQ ID NO: 367), GSGGG (SEQ ID NO: 368), GGGSG (SEQ ID NO: 369), and GSSSG (SEQ ID NO: 370).

In some embodiments, LP1 comprises the amino acid sequence GSSGGSGGSGGSG (SEQ ID NO: 371), GSSGGSGGSGG (SEQ ID NO: 372), GSSGGSGGSGGS (SEQ ID NO: 373), GSSGGSGGSGGSGGS (SEQ ID NO: 374), GSSGGSGGSG (SEQ ID NO: 375), GSSGGSGGSGS (SEQ ID NO: 376), GGGSSGGS (SEQ ID NO: 65), or GGGSSGG (SEQ ID NO: 1040).

In some embodiments, LP2 comprises the amino acid sequence GSS, GGS, GGGS (SEQ ID NO: 377), GSSGT (SEQ ID NO: 378) or GSSG (SEQ ID NO: 379).

In some embodiments, the AB has a dissociation constant ($K_d$) of about 100 nM or less for binding to PD-1.

In some embodiments, the activatable antibody includes an antibody or antigen-binding fragment thereof (AB) that specifically binds PD-1. In some embodiments, the antibody or antigen-binding fragment thereof that binds PD-1 is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, such an antibody or antigen-binding fragment thereof that binds PD-1 is a mouse, other rodent, chimeric, humanized or fully human monoclonal antibody.

In some embodiments, the activatable antibody comprises a heavy chain amino acid sequence that comprises or is derived from an amino acid sequence selected from the group consisting of SEQ ID NO: 1, 5, 9, 13, 17, 21, 23, 25, 27, 29, 31, 33, 35, and 37. In some embodiments, the activatable antibody comprises a light chain amino acid sequence selected from the group consisting of SEQ ID NO: 3, 7, 11, 15, 19, 39, 41, 43, 45, 47, 49, 51, 53, 55, 57, and 59.

In some embodiments, the activatable anti-PD-1 antibody includes a heavy chain that comprises or is derived from an amino acid sequence selected from the group consisting of SEQ ID NO: 21, 23, 25, 27, 29, 31, 33, 35, and 37, and a light chain that comprises or is derived from an amino acid sequence selected from the group consisting of SEQ ID NO: 39, 41, 43, 45, 47, 49, 51, 53, 55, 57, and 59.

In some embodiments, the activatable anti-PD-1 antibody includes a heavy chain that comprises or is derived from amino acid sequence SEQ ID NO: 21. In some embodiments, the activatable anti-PD-1 antibody includes a light chain that comprises or is derived from amino acid sequence SEQ ID NO: 45 or SEQ ID NO: 47. In some embodiments, the activatable anti-PD-1 antibody includes a heavy chain that comprises or is derived from amino acid sequence SEQ ID NO: 21 and a light chain that comprises or is derived from amino acid sequence SEQ ID NO: 45 or SEQ ID NO: 47. In some embodiments, the activatable anti-PD-1 antibody includes a heavy chain that comprises or is derived from amino acid sequence SEQ ID NO: 21 and a light chain that comprises or is derived from amino acid sequence SEQ ID NO: 45. In some embodiments, the activatable anti-PD-1 antibody includes a heavy chain that comprises or is derived from amino acid sequence SEQ ID NO: 21 and a light chain that comprises or is derived from amino acid sequence SEQ ID NO: 47.

In some embodiments, the activatable anti-PD-1 antibody includes the combination of the complementarity determining region (CDR) sequences of the heavy chain amino acid sequence of SEQ ID NO: 21. In some embodiments, the activatable anti-PD-1 antibody includes the combination of the CDR sequences of the light chain amino acid sequence of SEQ ID NO: 45 or of SEQ ID NO: 47. In some embodiments, the activatable anti-PD-1 antibody includes a combination of the CDR sequences of the heavy chain amino acid sequence of SEQ ID NO: 21, and the CDR sequences of the light chain amino acid sequence of SEQ ID NO: 45 or 47. In some embodiments, the activatable anti-PD-1 antibody includes a combination of the CDR sequences of the heavy chain amino acid sequence of SEQ ID NO: 21, and the CDR sequences of the light chain amino acid sequence of SEQ ID NO: 45. In some embodiments, the activatable anti-PD-1 antibody includes a combination of the CDR sequences of the heavy chain amino acid sequence of SEQ ID NO: 21, and the CDR sequences of the light chain amino acid sequence of SEQ ID NO: 47.

In some embodiments, the activatable anti-PD-1 antibody includes: (a) a variable heavy chain complementarity determining region 1 (VH CDR1) comprising an amino acid sequence selected from the group consisting of SEQ ID NOs: 653-657; (b) a variable heavy chain complementarity determining region 2 (VH CDR2) comprising an amino acid sequence selected from the group consisting of SEQ ID NOs: 658-663; (c) a variable heavy chain complementarity determining region 3 (VH CDR3) comprising an amino acid sequence selected from the group consisting of SEQ ID NOs: 664-668; (d) a variable light chain complementarity determining region 1 (VL CDR1) comprising an amino acid sequence selected from the group consisting of SEQ ID NOs:669-677; (e) a variable light chain complementarity determining region 2 (VL CDR2) comprising an amino acid sequence selected from the group consisting of SEQ ID NOs: 678-682; and (f) variable light chain complementarity determining region 3 (VL CDR3) comprising an amino acid sequence selected from the group consisting of SEQ ID NOs: 683-687.

In some embodiments, the activatable anti-PD-1 antibody includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664).

In some embodiments, the activatable anti-PD-1 antibody includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, the activatable anti-PD-1 antibody includes a combination of a VL CDR1 sequence, a VL CDR2 sequence, and a VL CDR3 sequence, wherein the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, the activatable anti-PD-1 antibody includes a combination of a VL CDR1 sequence, a VL CDR2 sequence, and a VL CDR3 sequence, wherein the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, the activatable anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, the activatable anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, the activatable anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, the activatable anti-PD-1 antibody includes a heavy chain that comprises or is derived from the amino acid sequence of SEQ ID NO: 1346, and a light chain that comprises or is derived from the amino acid sequence of SEQ ID NO: 626.

In some embodiments, the activatable anti-PD-1 antibody includes a heavy chain that comprises or is derived from the amino acid sequence of SEQ ID NO: 1514, and a light chain that comprises or is derived from the amino acid sequence of SEQ ID NO: 638.

In some embodiments, the activatable anti-PD-1 antibody includes the combination of the complementarity determining region (CDR) sequences of the heavy chain amino acid sequence of SEQ ID NO: 1346. In some embodiments, the activatable anti-PD-1 antibody includes the combination of the CDR sequences of the light chain amino acid sequence of SEQ ID NO: 626. In some embodiments, the activatable anti-PD-1 antibody includes a combination of the CDR sequences of the heavy chain amino acid sequence of SEQ ID NO: 1346, and the CDR sequences of the light chain amino acid sequence of SEQ ID NO: 626.

In some embodiments, the activatable anti-PD-1 antibody includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GITFSNSG (SEQ ID NO: 1705); the VH CDR2 sequence comprises IWYDGSKR (SEQ ID NO: 1706); and the VH CDR3 sequence comprises TNDDY (SEQ ID NO: 1707).

In some embodiments, the activatable anti-PD-1 antibody includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, the activatable anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GITFSNSG (SEQ ID NO: 1705); the VH CDR2 sequence comprises IWYDGSKR (SEQ ID NO: 1706); the VH CDR3 sequence comprises TNDDY (SEQ ID NO: 1707); the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, the activatable anti-PD-1 antibody includes the combination of the complementarity determining region (CDR) sequences of the heavy chain amino acid sequence of SEQ ID NO: 1514. In some embodiments, the activatable anti-PD-1 antibody includes the combination of the CDR sequences of the light chain amino acid sequence of SEQ ID NO: 638. In some embodiments, the activatable anti-PD-1 antibody includes a combination of the CDR sequences of the heavy chain amino acid sequence of SEQ ID NO: 1514, and the CDR sequences of the light chain amino acid sequence of SEQ ID NO: 638.

In some embodiments, the activatable anti-PD-1 antibody includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GYTFTNYY (SEQ ID NO: 1711); the VH CDR2 sequence comprises INPSNGGT (SEQ ID NO: 1712); and the VH CDR3 sequence comprises RRDYRFDMGFDY (SEQ ID NO: 1713).

In some embodiments, the activatable anti-PD-1 antibody includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, the activatable anti-PD-1 antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GYTFTNYY (SEQ ID NO: 1711); the VH CDR2 sequence comprises INPSNGGT (SEQ ID NO: 1712); the VH CDR3 sequence comprises RRDYRFDMGFDY (SEQ ID NO: 1713); the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37. In some embodiments, the activatable antibody comprises a light chain amino acid that is at least 90%, 91%, 92%, 93%, 94%, 95%, 96%, 97%, 98% or 99% identical to an amino acid sequence amino acid sequence selected from the group consisting of SEQ ID NO: 3, 7, 11, 15, 19, 39, 41, 43, 45, 47, 49, 51, 53, 55, 57, and 59. In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence amino acid sequence selected from the group consisting of SEQ ID NO: 3, 7, 11, 15, 19, 39, 41, 43, 45, 47, 49, 51, 53, 55, 57, and 59.

In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37. In some embodiments, the activatable antibody comprises a light chain amino acid that is at least 90%, 91%, 92%, 93%, 94%, 95%, 96%, 97%, 98% or 99% identical to an amino acid sequence amino acid sequence selected from the group consisting of SEQ ID NO: 39, 41, 43, 45, 47, 49, 51, 53, 55, 57, and 59. In some embodiments, the activatable antibody comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence amino acid sequence selected from the group consisting of SEQ ID NO: 39, 41, 43, 45, 47, 49, 51, 53, 55, 57, and 59. In some embodiments, the activatable anti-PD-1 antibody includes a heavy chain sequence that is at least 90%, 91%, 92%, 93%, 94%, 95%, 96%, 97%, 98% or 99% identical to the amino acid sequence of SEQ ID NO: 21, and a light chain sequence that is at least 90%, 91%, 92%, 93%, 94%, 95%, 96%, 97%, 98% or 99% identical to the amino acid sequence of SEQ ID NO: 45 or SEQ ID NO: 47. In some embodiments, the activatable anti-PD-1 antibody includes a heavy chain sequence that is at least 90%, 91%, 92%, 93%, 94%, 95%, 96%, 97%, 98% or 99% identical to the amino acid sequence of SEQ ID NO: 21, and a light chain sequence that is at least 90%, 91%, 92%, 93%, 94%, 95%, 96%, 97%, 98% or 99% identical to the amino acid sequence of SEQ ID NO: 45. In some embodiments, the activatable anti-PD-1 antibody includes a heavy chain sequence that is at least 90%, 91%, 92%, 93%, 94%, 95%, 96%, 97%, 98% or 99% identical to the amino acid sequence of SEQ ID NO: 21, and a light chain sequence that is at least 90%, 91%, 92%, 93%, 94%, 95%, 96%, 97%, 98% or 99% identical to the amino acid sequence of SEQ ID NO: 47.

In some embodiments, the activatable anti-PD-1 antibody includes a heavy chain sequence that is at least 90%, 91%, 92%, 93%, 94%, 95%, 96%, 97%, 98% or 99% identical to the amino acid sequence of SEQ ID NO: 1346, and a light chain sequence that is at least 90%, 91%, 92%, 93%, 94%, 95%, 96%, 97%, 98% or 99% identical to the amino acid sequence of SEQ ID NO: 626.

In some embodiments, the activatable anti-PD-1 antibody includes a heavy chain sequence that is at least 90%, 91%, 92%, 93%, 94%, 95%, 96%, 97%, 98% or 99% identical to the amino acid sequence of SEQ ID NO: 1514, and a light chain sequence that is at least 90%, 91%, 92%, 93%, 94%, 95%, 96%, 97%, 98% or 99% identical to the amino acid sequence of SEQ ID NO: 638.

In some embodiments, the AB of the activatable anti-PD-1 antibody comprises a heavy chain amino acid sequence selected from the group consisting of the heavy chain sequences shown in Table 7. In some embodiments, the AB of the activatable anti-PD-1 antibody comprises a light chain amino acid sequence selected from the group consisting of the light chain sequences shown in Table 7. In some embodiments, the AB of the activatable anti-PD-1 antibody comprises a heavy chain amino acid sequence selected from the group consisting of the heavy chain sequences shown in Table 7 and a light chain amino acid sequence selected from the group consisting of the light chain sequences shown in Table 7.

In some embodiments, the AB of the activatable anti-PD-1 antibody comprises a heavy chain amino acid sequence that is at least 90%, 91%, 92%, 93%, 94%, 95%, 96%, 97%, 98% or 99% identical to an amino acid sequence selected from the group consisting of the heavy chain sequences shown in Table 7. In some embodiments, the AB of the activatable anti-PD-1 antibody comprises a light chain amino acid sequence that is at least 90%, 91%, 92%, 93%, 94%, 95%, 96%, 97%, 98% or 99% identical to an amino acid sequence selected from the group consisting of the light chain sequences shown in Table 7. In some embodiments, the AB of the activatable anti-PD-1 antibody comprises a heavy chain amino acid sequence that is at least 90%, 91%, 92%, 93%, 94%, 95%, 96%, 97%, 98% or 99% identical to an amino acid sequence selected from the group consisting of the heavy chain sequences shown in Table 7 and a light chain amino acid sequence that is at least 90%, 91%, 92%, 93%, 94%, 95%, 96%, 97%, 98% or 99% identical to an amino acid sequence selected from the group consisting of the light chain sequences shown in Table 7.

In some embodiments, the AB of the activatable antibody includes a combination of a VH CDR1 sequence, a VH CDR2 sequence, and a VH CDR3 sequence, wherein the VH CDR1 sequence comprises a sequence that is at least 90%, 91%, 92%, 93%, 94%, 95%, 96%, 97%, 98%, 99% or more identical to GITFSNSG (SEQ ID NO: 1705); the VH CDR2 sequence comprises a sequence that is at least 90%, 91%, 92%, 93%, 94%, 95%, 96%, 97%, 98%, 99% or more identical to IWYDGSKR (SEQ ID NO: 1706); and the VH CDR3 sequence comprises a sequence that is at least 90%, 91%, 92%, 93%, 94%, 95%, 96%, 97%, 98%, 99% or more identical to TNDDY (SEQ ID NO: 1707).

In some embodiments, the AB of the activatable antibody includes a combination of a VL CDR1 sequence, a VL CDR2 sequence, and a VL CDR3 sequence, wherein the VL CDR1 sequence comprises a sequence that is at least 90%, 91%, 92%, 93%, 94%, 95%, 96%, 97%, 98%, 99% or more identical to QSVSSY (SEQ ID NO: 1708); the VL CDR2 sequence comprises a sequence that is at least 90%, 91%, 92%, 93%, 94%, 95%, 96%, 97%, 98%, 99% or more identical to DAS (SEQ ID NO: 1709); and the VL CDR3 sequence comprises a sequence that is at least 90%, 91%, 92%, 93%, 94%, 95%, 96%, 97%, 98%, 99% or more identical to QQSSNWPRT (SEQ ID NO: 1710).

In some embodiments, the AB of the activatable antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to GITFSNSG (SEQ ID NO: 1705); the VH CDR2 sequence comprises a sequence that is at least 90%, 91%, 92%, 93%, 94%, 95%, 96%, 97%, 98%, 99% or more identical to IWYDGSKR (SEQ ID NO: 1706); the VH CDR3 sequence comprises a sequence that is at least 90%, 91%, 92%, 93%, 94%, 95%, 96%, 97%, 98%, 99% or more identical to TNDDY (SEQ ID NO: 1707); the VL CDR1 sequence comprises a sequence that is at least 90%, 91%, 92%, 93%, 94%, 95%, 96%, 97%, 98%, 99% or more identical to QSVSSY (SEQ ID NO: 1708); the VL CDR2 sequence comprises a sequence that is at least 90%, 91%, 92%, 93%, 94%, 95%, 96%, 97%, 98%, 99% or more identical to DAS (SEQ ID NO: 1709); and the VL CDR3 sequence comprises a sequence that is at least 90%, 91%, 92%, 93%, 94%, 95%, 96%, 97%, 98%, 99% or more identical to QQSSNWPRT (SEQ ID NO: 1710).

In some embodiments, the AB of the activatable antibody includes a combination of a VH CDR1 sequence, a VH CDR2 sequence, and a VH CDR3 sequence, wherein the VH CDR1 sequence comprises a sequence that is at least 90%, 91%, 92%, 93%, 94%, 95%, 96%, 97%, 98%, 99% or more identical to GYTFTNYY (SEQ ID NO: 1711); the VH CDR2 sequence comprises a sequence that is at least 90%, 91%, 92%, 93%, 94%, 95%, 96%, 97%, 98%, 99% or more identical to INPSNGGT (SEQ ID NO: 1712); and the VH CDR3 sequence comprises a sequence that is at least 90%, 91%, 92%, 93%, 94%, 95%, 96%, 97%, 98%, 99% or more identical to RRDYRFDMGFDY (SEQ ID NO: 1713).

In some embodiments, the AB of the activatable antibody includes a combination of a VL CDR1 sequence, a VL CDR2 sequence, and a VL CDR3 sequence, wherein the VL CDR1 sequence comprises a sequence that is at least 90%, 91%, 92%, 93%, 94%, 95%, 96%, 97%, 98%, 99% or more identical to KGVSTSGYSY (SEQ ID NO: 1714); the VL CDR2 sequence comprises a sequence that is at least 90%, 91%, 92%, 93%, 94%, 95%, 96%, 97%, 98%, 99% or more identical to LAS (SEQ ID NO: 1715); and the VL CDR3 sequence comprises a sequence that is at least 90%, 91%, 92%, 93%, 94%, 95%, 96%, 97%, 98%, 99% or more identical to QHSRDLPLT (SEQ ID NO: 1716).

In some embodiments, the AB of the activatable antibody includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises a sequence that is at least 90%, 91%, 92%, 93%, 94%, 95%, 96%, 97%, 98%, 99% or more identical to GYTFTNYY (SEQ ID NO: 1711); the VH CDR2 sequence comprises a sequence that is at least 90%, 91%, 92%, 93%, 94%, 95%, 96%, 97%, 98%, 99% or more identical to INPSNGGT (SEQ ID NO: 1712); the VH CDR3 sequence comprises a sequence that is at least 90%, 91%, 92%, 93%, 94%, 95%, 96%, 97%, 98%, 99% or more identical to RRDYRFDMGFDY (SEQ ID NO: 1713); the VL CDR1 sequence comprises a sequence that is at least 90%, 91%, 92%, 93%, 94%, 95%, 96%, 97%, 98%, 99% or more identical to KGVSTSGYSY (SEQ ID NO: 1714); the VL CDR2 sequence comprises a sequence that is at least 90%, 91%, 92%, 93%, 94%, 95%, 96%, 97%, 98%, 99% or more identical to LAS (SEQ ID NO: 1715); and the VL CDR3 sequence comprises a sequence that is at least 90%, 91%, 92%, 93%, 94%, 95%, 96%, 97%, 98%, 99% or more identical to QHSRDLPLT (SEQ ID NO: 1716).

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 8; a VH CDR2 sequence shown in Table 8; a VH CDR3 sequence shown in Table 8; a VL CDR1 sequence shown in Table 8; a VL CDR2 sequence shown in Table 8; and a VL CDR3 sequence shown in Table 8.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 8; a VH CD2 sequence that includes a sequence that is at least 90%, 91%, 92%, 93%, 94%, 95%, 96%, 97%, 98%, 99% or more identical to a VH CDR2 sequence shown in Table 8; a VH CDR3 sequence that includes a sequence that is at least 90%, 91%, 92%, 93%, 94%, 95%, 96%, 97%, 98%, 99% or more identical to a VH CDR3 sequence shown in Table 8; a VL CDR1 sequence that includes a sequence that is at least 90%, 91%, 92%, 93%, 94%, 95%, 96%, 97%, 98%, 99% or more identical to a VL CDR1 sequence shown in Table 8; a VL CDR2 sequence that includes a sequence that is at least 90%, 91%, 92%, 93%, 94%, 95%, 96%, 97%, 98%, 99% or more identical to a VL CDR2 sequence shown in Table 8; and a VL CDR3 sequence that includes a sequence that is at least 90%, 91%, 92%, 93%, 94%, 95%, 96%, 97%, 98%, 99% or more identical to a VL CDR3 sequence shown in Table 8.

In some embodiments, the activatable antibody comprises a combination of a VH CDR1 sequence, a VH CDR2 sequence, a VH CDR3 sequence shown in a single row in Table 8, and a VL CDR1 sequence, a VL CDR2 sequence, and a VL CDR3 sequence shown in a single row in Table 8.

In some embodiments, the antibody comprises a heavy chain that comprises a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 8.

In some embodiments, the activatable antibody comprises a combination of a VH CDR1 sequence, a VH CDR2 sequence, a VH CDR3 sequence shown in a single row in Table 8, a VL CDR1 sequence, a VL CDR2 sequence, and a VL CDR3 sequence shown in a single row in Table 8, wherein each CDR sequence in the combination comprises a sequence that is at least 90%, 91%, 92%, 93%, 94%, 95%, 96%, 97%, 98%, 99% or more identical to the corresponding CDR sequence in a combination of the three VH CDR sequences (VH CDR1, VH CDR2, VH CDR3) shown in a single row in Table 8 and in a combination of the three VL CDR sequences (VL CDR1, VL CDR2, and VL CDR3) shown in a single row in Table 8.

In some embodiments, the antibody comprises a heavy chain that comprises a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 8.

In some embodiments, the activatable antibody comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 9; a VH CDR2 sequence shown in Table 9; a VH CDR3 sequence shown in Table 9; a VL CDR1 sequence shown in Table 9; a VL CDR2 sequence shown in Table 9; and a VL CDR3 sequence shown in Table 9.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 9; a VH CD2 sequence that includes a sequence that is at least 90%, 91%, 92%, 93%, 94%, 95%, 96%, 97%, 98%, 99% or more identical to a VH CDR2 sequence shown in Table 9; a VH CDR3 sequence that includes a sequence that is at least 90%, 91%, 92%, 93%, 94%, 95%, 96%, 97%, 98%, 99% or more identical to a VH CDR3 sequence shown in Table 9; a VL CDR1 sequence that includes a sequence that is at least 90%, 91%, 92%, 93%, 94%, 95%, 96%, 97%, 98%, 99% or more identical to a VL CDR1 sequence shown in Table 9; a VL CDR2 sequence that includes a sequence that is at least 90%, 91%, 92%, 93%, 94%, 95%, 96%, 97%, 98%, 99% or more identical to a VL CDR2 sequence shown in Table 9; and a VL CDR3 sequence that includes a sequence that is at least 90%, 91%, 92%, 93%, 94%, 95%, 96%, 97%, 98%, 99% or more identical to a VL CDR3 sequence shown in Table 9.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein the combination is a combination shown in Table 9.

In some embodiments, the activatable antibody comprises a combination of a VH CDR1 sequence, a VH CDR2 sequence, a VH CDR3 sequence, a VL CDR1 sequence, a VL CDR2 sequence, and a VL CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination shown in Table 9.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675 or SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675 or SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, and a human immunoglobulin light chain constant domain. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675 or SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, and a human immunoglobulin heavy chain constant domain. In some embodiments, the human immunoglobulin heavy chain constant domain comprises an amino acid sequence selected from the group consisting of 381, 382, 383, and 1807.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675 or SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, a human immunoglobulin heavy chain constant region, and a human immunoglobulin light chain constant domain. In some embodiments, the human immunoglobulin heavy chain constant domain comprises an amino acid sequence selected from the group consisting of SEQ ID NO: 63, 381, 382, 383, and 1807, and the human immunoglobulin light chain constant domain is a human kappa constant domain comprising SEQ ID NO: 61 or SEQ ID NO: 1344.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, and a human immunoglobulin light chain constant domain. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, and a human immunoglobulin heavy chain constant domain. In some embodiments, the human immunoglobulin heavy chain constant domain comprises an amino acid sequence selected from the group consisting of SEQ ID NO: 63, 381, 382, 383, and 1807.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 675; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, a human immunoglobulin heavy chain constant region, and a human immunoglobulin light chain constant domain. In some embodiments, the human immunoglobulin heavy chain constant domain comprises an amino acid sequence selected from the group consisting of SEQ ID NO: 63, 381, 382, 383, and 1807, and the human immunoglobulin light chain constant domain is a human kappa constant domain comprising SEQ ID NO: 61 or SEQ ID NO: 1344.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, and a human immunoglobulin light chain constant domain. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, and a human immunoglobulin heavy chain constant domain. In some embodiments, the human immunoglobulin heavy chain constant domain comprises an amino acid sequence selected from the group consisting of SEQ ID NO: 63, 381, 382, 383, and 1807.

In some embodiments, the activatable antibody comprises a masking moiety (MM) comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664, a human immunoglobulin heavy chain constant region, and a human immunoglobulin light chain constant domain. In some embodiments, the human immunoglobulin heavy chain constant domain comprises an amino acid sequence selected from the group consisting of SEQ ID NO: 63, 381, 382, 383, and 1807, and the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 66, 67, 70, 71, 74, 77, 81, 82, 84, 90, 91, 93, 99; a CM comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 66, 67, 70, 71, 74, 77, 81, 82, 84, 90, 91, 93, 99; a CM comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 66, 67, 70, 71, 74, 77, 81, 82, 84, 90, 91, 93, 99; a cleavable moiety (CM) comprising an amino acid sequence selected from the group consisting of SEQ ID NOs: 214, 294, 300, 302, 303, 305, 308, 318, 347, 361, 1092-1102, 1111, and 1157; and a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), which is referred to herein as mask PD034 or PD34, a cleavable moiety (CM) comprising the amino acid sequence ISSGLLSGRSDNP (SEQ ID NO: 1100), which is also referred to herein as substrate 2011, and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNP (SEQ ID NO: 1100), and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNP (SEQ ID NO: 1100), and a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), which is referred to herein as mask PD034 or PD34, a cleavable moiety (CM) comprising the amino acid sequence ISSGLLSGRSANP (SEQ ID NO: 1101), which is also referred to herein as substrate 2012, and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSANP (SEQ ID NO: 1101), and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSANP (SEQ ID NO: 1101), and a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), which is referred to herein as mask PD034 or PD34, a cleavable moiety (CM) comprising the amino acid sequence ISSGLLSGRSDNP (SEQ ID NO: 1100), which is also referred to herein as substrate 2011, and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47. In some embodiments, the combination further comprises a human immunoglobulin heavy chain constant region, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNP (SEQ ID NO: 1100), and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNP (SEQ ID NO: 1100), and a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), which is referred to herein as mask PD034 or PD34, a cleavable moiety (CM) comprising the amino acid sequence ISSGLLSGRSDNH (SEQ ID NO: 214), which is also referred to herein as substrate 2001, and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNH (SEQ ID NO: 214), and a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNH (SEQ ID NO: 214), and a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSGNH (SEQ ID NO: 361), which is also referred to herein as substrate 2002, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSANPRG (SEQ ID NO: 1092), which is also referred to herein as substrate 2003, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDDH (SEQ ID NO: 1095), which is also referred to herein as substrate 2006, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDIH (SEQ ID NO: 1096), which is also referred to herein as substrate 2007, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDQH (SEQ ID NO: 1097), which is also referred to herein as 2008, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDTH (SEQ ID NO: 1098), which is also referred to herein as substrate 2009, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDYH (SEQ ID NO: 1099), which is also referred to herein as 2010, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSANI (SEQ ID NO: 1102), which is also referred to herein as substrate 2013, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a masking moiety (MM) comprising the amino acid sequence TSYCSIEHYPCNTHH (SEQ ID NO: 99), a cleavable moiety (CM) comprising the amino acid sequence ISSGLLSGRSDNI (SEQ ID NO: 1111), which is also referred to herein as substrate 2014, and a combination selected from the group consisting of (a) a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 21 and the VL CDR sequences of the variable light chain sequence of SEQ ID NO: 47; (b) a combination of a VH CDR1 sequence, a VH CDR2 sequence, a VH CDR3 sequence, a VL CDR1 sequence, a VL CDR2 sequence, and a VL CDR3 sequence, wherein the combination comprises the VL CDR1 sequence of SEQ ID NO: 676; the VL CDR2 sequence of SEQ ID NO: 678; the VL CDR3 sequence of SEQ ID NO: 683; the VH CDR1 sequence of SEQ ID NO: 653; the VH CDR2 sequence of SEQ ID NO: 658; and the VH CDR3 sequence of SEQ ID NO: 664; and (c) a combination of a variable heavy chain (VH) sequence of SEQ ID NO: 21 and a variable light chain (VL) sequence of SEQ ID NO: 47. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a light chain comprising the amino acid sequence of SEQ ID NO: 1151; and a heavy chain comprising the amino acid sequence of SEQ ID NO:21.

In some embodiments, the activatable antibody comprises a light chain comprising the amino acid sequence of SEQ ID NO: 1152; and a heavy chain comprising the amino acid sequence of SEQ ID NO:21.

In some embodiments, the activatable antibody comprises a light chain comprising the amino acid sequence of SEQ ID NO: 1190; and a heavy chain comprising the amino acid sequence of SEQ ID NO:21.

In some embodiments, the activatable antibody comprises a light chain comprising the amino acid sequence of SEQ ID NO: 1191; and a heavy chain comprising the amino acid sequence of SEQ ID NO:21.

In some embodiments, the activatable antibody comprises a light chain comprising the amino acid sequence of SEQ ID NO: 1198; and a heavy chain comprising the amino acid sequence of SEQ ID NO:21.

In some embodiments, the activatable antibody comprises a light chain comprising the amino acid sequence of SEQ ID NO: 1199; and a heavy chain comprising the amino acid sequence of SEQ ID NO:21.

In some embodiments, the activatable antibody comprises a light chain comprising the amino acid sequence of SEQ ID NO: 2055; and a heavy chain comprising the amino acid sequence of SEQ ID NO: 2052.

In some embodiments, the activatable antibody comprises a light chain comprising the amino acid sequence of SEQ ID NO: 2054; and a heavy chain comprising the amino acid sequence of SEQ ID NO: 2052.

In some embodiments, the activatable antibody comprises a light chain comprising the amino acid sequence of SEQ ID NO: 2057; and a heavy chain comprising the amino acid sequence of SEQ ID NO: 2052.

In some embodiments, the activatable antibody comprises a light chain comprising the amino acid sequence of SEQ ID NO: 2056; and a heavy chain comprising the amino acid sequence of SEQ ID NO: 2052.

In some embodiments, the activatable antibody comprises a light chain comprising the amino acid sequence of SEQ ID NO: 2059; and a heavy chain comprising the amino acid sequence of SEQ ID NO: 2052.

In some embodiments, the activatable antibody comprises a light chain comprising the amino acid sequence of SEQ ID NO: 2058; and a heavy chain comprising the amino acid sequence of SEQ ID NO: 2052.

In some embodiments, the activatable antibody comprises a light chain comprising the amino acid sequence of SEQ ID NO: 2055; and a heavy chain comprising the amino acid sequence of SEQ ID NO: 2053.

In some embodiments, the activatable antibody comprises a light chain comprising the amino acid sequence of SEQ ID NO: 2054; and a heavy chain comprising the amino acid sequence of SEQ ID NO: 2053.

In some embodiments, the activatable antibody comprises a light chain comprising the amino acid sequence of SEQ ID NO: 2057; and a heavy chain comprising the amino acid sequence of SEQ ID NO: 2053.

In some embodiments, the activatable antibody comprises a light chain comprising the amino acid sequence of SEQ ID NO: 2056; and a heavy chain comprising the amino acid sequence of SEQ ID NO: 2053.

In some embodiments, the activatable antibody comprises a light chain comprising the amino acid sequence of SEQ ID NO: 2059; and a heavy chain comprising the amino acid sequence of SEQ ID NO: 2053.

In some embodiments, the activatable antibody comprises a light chain comprising the amino acid sequence of SEQ ID NO: 2058; and a heavy chain comprising the amino acid sequence of SEQ ID NO: 2053.

In some embodiments, the activatable antibody comprises a masking moiety (MM) comprising an amino acid sequence selected from the group consisting of SEQ ID NOs: 1351-1362; a cleavable moiety (CM) comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 1514 and the VL CDR sequences of the variable light chain sequence of SEQ ID NO: 638. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 1351-1362; a CM comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GYTFTNYY (SEQ ID NO: 1711); the VH CDR2 sequence comprises INPSNGGT (SEQ ID NO: 1712); the VH CDR3 sequence comprises RRDYRFDMGFDY (SEQ ID NO: 1713); the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716). In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 1351-1362; a CM comprising an amino acid sequence selected from the group consisting of SEQ ID NOs: 214, 294, 300, 302, 303, 305, 308, 318, 347, 361, 1092-1102, 1111, and 1157; the VH sequence of SEQ ID NO: 1514 and the VL sequence of SEQ ID NO: 638. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 1206-1217; a CM comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the combination comprises the VH CDR sequences of the variable heavy chain sequence of SEQ ID NO: 1346 and the VL CDR sequences of the variable light chain sequence of SEQ ID NO: 626. In some embodiments, the combination further comprises a human immunoglobulin heavy chain constant region, a human immunoglobulin light chain constant region, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 1206-1217; a CM comprising an amino acid sequence selected from the group consisting of SEQ ID NOs: 214, 294, 300, 302, 303, 305, 308, 318, 347, 361, 1092-1102, 1111, and 1157; and a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GITFSNSG (SEQ ID NO: 1705); the VH CDR2 sequence comprises IWYDGSKR (SEQ ID NO: 1706); the VH CDR3 sequence comprises TNDDY (SEQ ID NO: 1707); the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710). In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising an amino acid sequence selected from the group consisting of SEQ ID NOs: 1206-1217; a CM comprising an amino acid sequence selected from the group consisting of SEQ ID NOs: 214, 294, 300, 302, 303, 305, 308, 318, 347, 361, 1092-1102, 1111, and 1157; the VH sequence of SEQ ID NO: 1346 and the VL sequence of SEQ ID NO: 626. In some embodiments, the combination further comprises a human immunoglobulin heavy chain constant region, a human immunoglobulin light chain constant domain, or both a human immunoglobulin heavy chain constant region and a human immunoglobulin light chain constant domain. In some embodiments, the human immunoglobulin heavy chain constant domain comprises an amino acid sequence selected from the group consisting of SEQ ID NO: 63, 381, 382, 383, and 1807. In some embodiments, the human immunoglobulin light chain constant domain is a human kappa constant domain comprising SEQ ID NO: 61 or SEQ ID NO: 1344.

In some embodiments, the activatable antibody comprises a MM comprising the amino acid sequence ACRICQDHPATKWNS (SEQ ID NO: 549), a CM comprising the amino acid sequence ISSGLLSGRSANP (SEQ ID NO: 1101), which is also referred to herein as substrate 2012; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDNP (SEQ ID NO: 1100), which is also referred to herein as substrate 2011; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDNH (SEQ ID NO: 214), which is also referred to herein as substrate 2001; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSGNH (SEQ ID NO: 361), which is also referred to herein as substrate 2002; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSANPRG (SEQ ID NO: 1092), which is also referred to herein as substrate 2003; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDDH (SEQ ID NO: 1095), which is also referred to herein as substrate 2006; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDIH (SEQ ID NO: 1096), which is also referred to herein as substrate 2007; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDQH (SEQ ID NO: 1097), which is also referred to herein as substrate 2008; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDTH (SEQ ID NO: 1098), which is also referred to herein as substrate 2009; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDYH (SEQ ID NO: 1099), which is also referred to herein as substrate 2010; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSANI (SEQ ID NO: 1102), which is also referred to herein as substrate 2013; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDNI (SEQ ID NO: 1111), which is also referred to herein as substrate 2014; the heavy chain (HC) sequence of SEQ ID NO: 546, and the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSANP (SEQ ID NO: 1101), which is also referred to herein as substrate 2012; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDHPATKWNS (SEQ ID NO: 549), a CM comprising the amino acid sequence ISSGLLSGRSDNP (SEQ ID NO: 1100), which is also referred to herein as substrate 2011; the variable heavy chain region (VH) of the heavy chain (HC)

sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDNH (SEQ ID NO: 214), which is also referred to herein as substrate 2001; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSGNH (SEQ ID NO: 361), which is also referred to herein as substrate 2002; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSANPRG (SEQ ID NO: 1092), which is also referred to herein as substrate 2003; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDDH (SEQ ID NO: 1095), which is also referred to herein as substrate 2006; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDIH (SEQ ID NO: 1096), which is also referred to herein as substrate 2007; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDQH (SEQ ID NO: 1097), which is also referred to herein as substrate 2008; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDTH (SEQ ID NO: 1098), which is also referred to herein as substrate 2009; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDYH (SEQ ID NO: 1099), which is also referred to herein as substrate 2010; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSANI (SEQ ID NO: 1102), which is also referred to herein as substrate 2013; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDNI (SEQ ID NO: 1111), which is also referred to herein as substrate 2014; the variable heavy chain region (VH) of the heavy chain (HC) sequence of SEQ ID NO: 546, and the variable light chain region (VL) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSANP (SEQ ID NO: 1101), which is also referred to herein as substrate 2012; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDNP (SEQ ID NO: 1100), which is also referred to herein as substrate 2011; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDNH (SEQ ID NO: 214), which is also referred to herein as substrate 2001; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSGNH (SEQ ID NO: 361), which is also referred to herein as substrate 2002; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSANPRG (SEQ ID NO: 1092), which is also referred to herein as substrate 2003; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDDH (SEQ ID NO: 1095), which is also referred to herein as substrate 2006; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDIH (SEQ ID NO: 1096), which is also referred to herein as substrate 2007; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDQH (SEQ ID NO: 1097), which is also referred to herein as substrate 2008; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDTH (SEQ ID NO: 1098), which is also referred to herein as substrate 2009; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDYH (SEQ ID NO: 1099), which is also referred to herein as substrate 2010; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSANI (SEQ ID NO: 1102), which is also referred to herein as substrate 2013; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a MM comprising the amino acid sequence ACRICQDH-PATKWNS (SEQ ID NO: 549), a CM comprising the amino acid sequence ISSGLLSGRSDNI (SEQ ID NO: 1111), which is also referred to herein as substrate 2014; the heavy chain complementarity determining regions (CDRs) of the heavy chain (HC) sequence of SEQ ID NO: 546, and the light chain complementarity determining regions (CDRs) of the light chain (LC) sequence of SEQ ID NO: 543.

In some embodiments, the activatable antibody comprises a light chain comprising an amino acid sequence selected from the group consisting of SEQ ID NOs: 1808, 1810, 1812, 1814, 1816, 1818, 1820, 1822, 1824, 1826, 1828, and 1830; and a heavy chain comprising the amino acid sequence of SEQ ID NO: 546.

In some embodiments, the activatable antibody comprises a light chain comprising the amino acid sequence of SEQ ID NO: 1808; and a heavy chain comprising the amino acid sequence of SEQ ID NO: 546.

In some embodiments, the activatable antibody comprises a light chain comprising the amino acid sequence of SEQ ID NO: 1810; and a heavy chain comprising the amino acid sequence of SEQ ID NO: 546.

In some embodiments, the activatable antibody comprises a light chain comprising the amino acid sequence of SEQ ID NO: 1812; and a heavy chain comprising the amino acid sequence of SEQ ID NO: 546.

In some embodiments, the activatable antibody comprises a light chain comprising the amino acid sequence of SEQ ID NO: 1814; and a heavy chain comprising the amino acid sequence of SEQ ID NO: 546.

In some embodiments, the activatable antibody comprises a light chain comprising the amino acid sequence of SEQ ID NO: 1816; and a heavy chain comprising the amino acid sequence of SEQ ID NO: 546.

In some embodiments, the activatable antibody comprises a light chain comprising the amino acid sequence of SEQ ID NO: 1818; and a heavy chain comprising the amino acid sequence of SEQ ID NO: 546.

In some embodiments, the activatable antibody comprises a light chain comprising the amino acid sequence of SEQ ID NO: 1820; and a heavy chain comprising the amino acid sequence of SEQ ID NO: 546.

In some embodiments, the activatable antibody comprises a light chain comprising the amino acid sequence of SEQ ID NO: 1822; and a heavy chain comprising the amino acid sequence of SEQ ID NO: 546.

In some embodiments, the activatable antibody comprises a light chain comprising the amino acid sequence of SEQ ID NO: 1824; and a heavy chain comprising the amino acid sequence of SEQ ID NO: 546.

In some embodiments, the activatable antibody comprises a light chain comprising the amino acid sequence of SEQ ID NO: 1826; and a heavy chain comprising the amino acid sequence of SEQ ID NO: 546.

In some embodiments, the activatable antibody comprises a light chain comprising the amino acid sequence of SEQ ID NO: 1828; and a heavy chain comprising the amino acid sequence of SEQ ID NO: 546.

In some embodiments, the activatable antibody comprises a light chain comprising the amino acid sequence of SEQ ID NO: 1830; and a heavy chain comprising the amino acid sequence of SEQ ID NO: 546.

In some embodiments, the activatable antibody is encoded by a nucleic acid sequence that comprises a nucleic acid sequence encoding a heavy chain amino acid sequence selected from the group consisting of SEQ ID NO: 1, 5, 9, 13, 17, 21, 23, 25, 27, 29, 31, 33, 35, and 37. In some embodiments, the activatable antibody is encoded by a nucleic acid sequence that comprises a nucleic acid sequence encoding a heavy chain amino acid sequence selected from the group consisting of SEQ ID NO: 21, 23, 25, 27, 29, 31, 33, 35, and 37.

In some embodiments, the activatable antibody is encoded by a nucleic acid sequence that comprises a nucleic acid sequence encoding a light chain amino acid sequence selected from the group consisting of SEQ ID NO: 3, 7, 11, 15, 19, 39, 41, 43, 45, 47, 49, 51, 53, 55, 57, and 59. In some embodiments, the activatable antibody is encoded by a nucleic acid sequence that comprises a nucleic acid sequence encoding a light chain amino acid sequence selected from the group consisting of SEQ ID NO: 39, 41, 43, 45, 47, 49, 51, 53, 55, 57, and 59.

In some embodiments, the activatable antibody is encoded by a nucleic acid sequence that comprises a nucleic acid sequence encoding a heavy chain amino acid sequence selected from the group consisting of SEQ ID NO: 1, 5, 9, 13, 17, 21, 23, 25, 27, 29, 31, 33, 35, and 37, and a nucleic acid sequence that comprises a nucleic acid sequence encoding a light chain amino acid sequence selected from the group consisting of SEQ ID NO: 3, 7, 11, 15, 19, 39, 41, 43, 45, 47, 49, 51, 53, 55, 57, and 59.

In some embodiments, the activatable antibody is encoded by a nucleic acid sequence that comprises a nucleic acid sequence encoding a heavy chain amino acid sequence selected from the group consisting of SEQ ID NO: 21, 23, 25, 27, 29, 31, 33, 35, and 37, and a nucleic acid sequence that comprises a nucleic acid sequence encoding a light chain amino acid sequence selected from the group consisting of SEQ ID NO: 39, 41, 43, 45, 47, 49, 51, 53, 55, 57, and 59.

In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37. In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37.

In some embodiments, the activatable antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 3, 7, 11, 15, 19, 39, 41, 43, 45, 47, 49, 51, 53, 55, 57, and 59. In some embodiments, the activatable antibody is encoded by a nucleic acid sequence that comprises a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 39, 41, 43, 45, 47, 49, 51, 53, 55, 57, and 59.

In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37, and a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 3, 7, 11, 15, 19, 39, 41, 43, 45, 47, 49, 51, 53, 55, 57, and 59.

In some embodiments, the activatable antibody is encoded by a nucleic acid sequence that comprises a nucleic acid sequence encoding a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37, and a nucleic acid sequence that comprises a nucleic acid sequence encoding a light chain amino acid that is at least 90%, 91%, 92%, 93%, 94%, 95%, 96%, 97%, 98% or 99% identical to the amino acid sequence selected from the group consisting of SEQ ID NO: 39, 41, 43, 45, 47, 49, 51, 53, 55, 57, and 59.

In some embodiments, the activatable antibody is encoded by a heavy chain nucleic acid sequence selected from the group consisting of SEQ ID NO: 2, 6, 10, 14, 18, 22, 24, 26, 28, 30, 32, 34, 36, and 38. In some embodiments, the activatable antibody is encoded by a heavy chain nucleic acid sequence selected from the group consisting of SEQ ID NO: 22, 24, 26, 28, 30, 32, 34, 36, and 38.

In some embodiments, the activatable antibody is encoded by a light chain nucleic acid sequence selected from the group consisting of SEQ ID NO: 4, 8, 12, 16, 20, 40, 42, 44, 46, 48, 50, 52, 54, 56, 58, and 60. In some embodiments, the activatable antibody is encoded by a light chain nucleic acid sequence selected from the group consisting of SEQ ID NO: 40, 42, 44, 46, 48, 50, 52, 54, 56, 58, and 60.

In some embodiments, the activatable antibody is encoded by heavy chain nucleic acid sequence selected from the group consisting of SEQ ID NO: selected from the group consisting of SEQ ID NO: 2, 6, 10, 14, 18, 22, 24, 26, 28, 30, 32, 34, 36, and 38, and a light chain nucleic acid sequence selected from the group consisting of SEQ ID NO: 4, 8, 12, 16, 20, 40, 42, 44, 46, 48, 50, 52, 54, 56, 58, and 60. In some embodiments, the activatable antibody is encoded by heavy chain nucleic acid sequence selected from the group consisting of SEQ ID NO: selected from the group consisting of SEQ ID NO: 22, 24, 26, 28, 30, 32, 34, 36, and 38, and a light chain nucleic acid sequence selected from the group consisting of SEQ ID NO: 40, 42, 44, 46, 48, 50, 52, 54, 56, 58, and 60.

In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 2, 6, 10, 14, 18, 22, 24, 26, 28, 30, 32, 34, 36, and 38. In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 22, 24, 26, 28, 30, 32, 34, 36, and 38.

In some embodiments, the activatable antibody is encoded by a nucleic acid sequence that is at least 90%, 91%, 92%, 93%, 94%, 95%, 96%, 97%, 98% or 99% identical to a light chain nucleic acid sequence selected from the group consisting of SEQ ID NO: 4, 8, 12, 16, 20, 40, 42, 44, 46, 48, 50, 52, 54, 56, 58, and 60. In some embodiments, the activatable antibody is encoded by a nucleic acid sequence that is at least 90%, 91%, 92%, 93%, 94%, 95%, 96%, 97%, 98% or 99% identical to a light chain nucleic acid sequence selected from the group consisting of SEQ ID NO: 40, 42, 44, 46, 48, 50, 52, 54, 56, 58, and 60.

In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 2, 6, 10, 14, 18, 22, 24, 26, 28, 30, 32, 34, 36, and 38, and a nucleic acid sequence that is at least 90%, 91%, 92%, 93%, 94%, 95%, 96%, 97%, 98% or 99% identical to a light chain nucleic acid sequence selected from the group consisting of SEQ ID NO: 4, 8, 12, 16, 20, 40, 42, 44, 46, 48, 50, 52, 54, 56, 58, and 60. In some embodiments, the activatable antibody is encoded by a nucleic acid sequence that is at least 90%, 91%, 92%, 93%, 94%, 95%, 96%, 97%, 98% or 99% identical to a heavy chain nucleic acid sequence selected from the group consisting of SEQ ID NO: 22, 24, 26, 28, 30, 32, 34, 36, and 38, and a nucleic acid sequence that is at least 90%, 91%, 92%, 93%, 94%, 95%, 96%, 97%, 98% or 99% identical to a light chain nucleic acid sequence selected from the group consisting of SEQ ID NO: 40, 42, 44, 46, 48, 50, 52, 54, 56, 58, and 60.

In some embodiments, the MM has a dissociation constant, i.e., dissociation constant at an equilibrium state, $K_d$ for binding to the AB that is greater than the $K_d$ for binding of the AB to PD-1.

In some embodiments, the MM has a $K_d$ for binding to the AB that is no more than the $K_d$ for binding of the AB to PD-1.

In some embodiments, the MM has a $K_d$ for binding to the AB that is no less than the $K_d$ for binding of the AB to PD-1.

In some embodiments, the MM has a $K_d$ for binding to the AB that is approximately equal to the $K_d$ for binding of the AB to PD-1.

In some embodiments, the MM has a $K_d$ for binding to the AB that is less than the $K_d$ for binding of the AB to PD-1.

In some embodiments, the MM has a $K_d$ for binding to the AB that is no more than 2, 3, 4, 5, 10, 25, 50, 100, 250, 500, or 1,000 fold greater than the $K_d$ for binding of the AB to PD-1. In some embodiments, the MM has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to PD-1.

In some embodiments, the MM has an affinity for binding to the AB that is less than the affinity of binding of the AB to PD-1.

In some embodiments, the MM has an affinity for binding to the AB that is no more than the affinity of binding of the AB to PD-1.

In some embodiments, the MM has an affinity for binding to the AB that is approximately equal of the affinity of binding of the AB to PD-1.

In some embodiments, the MM has an affinity for binding to the AB that is no less than the affinity of binding of the AB to PD-1.

In some embodiments, the MM has an affinity for binding to the AB that is greater than the affinity of binding of the AB to PD-1.

In some embodiments, the MM has an affinity for binding to the AB that is 2, 3, 4, 5, 10, 25, 50, 100, 250, 500, or 1,000 less than the affinity of binding of the AB to PD-1. I In some embodiments, the MM has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to PD-1. In some embodiments, the MM has an affinity for binding to the AB that is 2 to 20 fold less than the affinity of binding of the AB to PD-1. In some embodiments, a MM not covalently linked to the AB and at equimolar concentration to the AB does not inhibit the binding of the AB to PD-1.

In some embodiments, the MM does not interfere or compete with the AB for binding to PD-1 when the activatable antibody is in a cleaved state.

In some embodiments, the MM is a polypeptide of about 2 to 40 amino acids in length. In some embodiments, the MM is a polypeptide of up to about 40 amino acids in length.

In some embodiments, the MM is a polypeptide of no more than 40 amino acids in length.

In some embodiments, the MM polypeptide sequence is different from that of PD-1. In some embodiments, the MM polypeptide sequence is different from that of human PD-1. In some embodiments, the MM polypeptide sequence is no more than 50% identical to any natural binding partner of the AB. In some embodiments, the MM polypeptide sequence is different from that of PD-1 and is no more than 40%, 30%, 25%, 20%, 15%, or 10% identical to any natural binding partner of the AB. In some embodiments, the MM polypeptide sequence is no more than 50% identical to human PD-1. In some embodiments, the MM polypeptide sequence is different from that of PD-1 and is no more than 40%, 30%, 25%, 20%, 15%, or 10% identical to human PD-1.

In some embodiments, the MM comprises an amino acid sequence selected from the group consisting of SEQ ID NOs: 66-213, 384-514, 548-571, 1206-1295, and 1351-1465. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 66-213, 384-514, 548-571, 1206-1295, and 1351-1465. In some embodiments, the MM comprises an amino acid sequence selected from the group consisting of SEQ ID NOs: 66, 67, 70, 71, 74, 77, 81, 82, 84, 90, 91, 93, and 99. In some embodiments, the MM comprises an amino acid sequence selected from the group consisting of SEQ ID NOs: 66, 71, 74, 77, 82, 84, 90, 91, 93, and 99. In some embodiments, the MM comprises an amino acid sequence selected from the group consisting of SEQ ID NOs: 1206-1217. In some embodiments, the MM comprises an amino acid sequence selected from the group consisting of SEQ ID NOs: 1351-1362.

In some embodiments, the MM comprises an amino acid sequence selected from the group consisting of SEQ ID NOs: 66-213. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 66-213.

In some embodiments, the MM comprises an amino acid sequence selected from the group consisting of SEQ ID NOs: 384-514. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 384-514.

In some embodiments, the MM comprises an amino acid sequence selected from the group consisting of SEQ ID NOs: 548-571. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 548-571.

In some embodiments, the MM comprises an amino acid sequence selected from the group consisting of SEQ ID NOs: 1206-1295. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 1206-1295.

In some embodiments, the MM comprises an amino acid sequence selected from the group consisting of SEQ ID NOs: 1351-1465. In some embodiments, the MM comprises an amino acid sequence that is at least 90%, 91%, 92%, 93%, 94%, 95%, 96%, 97%, 98% or 99% identical to an amino acid sequence selected from the group consisting of SEQ ID NOs: 1351-1465.

In some embodiments, the antibody or activatable antibody comprises a heavy chain comprising an amino acid selected from the group consisting of SEQ ID NOs: 2052 and 2053.

In some embodiments, the antibody or activatable antibody comprises a light chain comprising an amino acid selected from the group consisting of SEQ ID NOs: 2054 to 2059.

In some embodiments, the antibody or activatable antibody comprises a heavy chain comprising an amino acid selected from the group consisting of SEQ ID NOs: 2052 and 2053 and a light chain comprising an amino acid selected from the group consisting of SEQ ID NOs: 2054 to 2059.

In some embodiments, the coupling of the MM to the AB reduces the ability of the AB to bind PD-1 such that the dissociation constant ($K_d$) of the AB when coupled to the MM towards PD-1 is at least two times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least five times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least 10 times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least 20 times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least 40 times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least 100 times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least 1000 times greater than the $K_d$ of the AB when not coupled to the MM towards PD-1.

In some embodiments, the coupling of the MM to the AB reduces the ability of the AB to bind PD-1 such that the dissociation constant ($K_d$) of the AB when coupled to the MM towards PD-1 is at least 10,000 times greater than the $K_d$ of the AB when not coupled to the MM towards PD-1.

In some embodiments, in the presence of PD-1, the MM reduces the ability of the AB to bind PD-1 by at least 90% when the CM is uncleaved, as compared to when the CM is cleaved when assayed in vitro using a target displacement assay such as, for example, the assay described in PCT Publication No. WO 2010/081173, the contents of which are hereby incorporated by reference in their entirety.

In some embodiments, the protease that cleaves the CM is active, e.g., up-regulated, in diseased tissue, and the protease cleaves the CM in the activatable antibody when the activatable antibody is exposed to the protease.

In some embodiments, the protease is produced by a tumor that is in proximity to T cells that express PD-1, and the protease cleaves the CM in the activatable antibody when the activatable antibody is exposed to the protease. In some embodiments, the protease is produced by a tumor that is co-localized with T cells that express PD-1, and the protease cleaves the CM in the activatable antibody when the activatable antibody is exposed to the protease.

In some embodiments, the CM is positioned in the activatable antibody such that when the activatable antibody is in the uncleaved state, binding of the activatable antibody to PD-1 is reduced to occur with a dissociation constant that is at least twofold greater than the dissociation constant of an unmodified AB binding to PD-1, whereas in the cleaved state (i.e., when the activatable antibody is in the cleaved state), the AB binds PD-1.

In some embodiments, the CM is positioned in the activatable antibody such that when the activatable antibody is in the uncleaved state, binding of the activatable antibody to PD-1 is reduced to occur with a dissociation constant that is at least fivefold greater than the dissociation constant of an unmodified AB binding to PD-1, whereas in the cleaved state (i.e., when the activatable antibody is in the cleaved state), the AB binds PD-1.

In some embodiments, the CM is positioned in the activatable antibody such that when the activatable antibody is in the uncleaved state, binding of the activatable antibody to PD-1 is reduced to occur with a dissociation constant that is at least 10-fold greater than the dissociation constant of an unmodified AB binding to PD-1, whereas in the cleaved state (i.e., when the activatable antibody is in the cleaved state), the AB binds PD-1.

In some embodiments, the CM is positioned in the activatable antibody such that when the activatable antibody is in the uncleaved state, binding of the activatable antibody to PD-1 is reduced to occur with a dissociation constant that is at least 20-fold greater than the dissociation constant of an unmodified AB binding to PD-1, whereas in the cleaved state (i.e., when the activatable antibody is in the cleaved state), the AB binds PD-1.

In some embodiments, the CM is positioned in the activatable antibody such that when the activatable antibody is in the uncleaved state, binding of the activatable antibody to PD-1 is reduced to occur with a dissociation constant that is at least 40-fold greater than the dissociation constant of an unmodified AB binding to PD-1, whereas in the cleaved state, the AB binds PD-1.

In some embodiments, the CM is positioned in the activatable antibody such that when the activatable antibody is in the uncleaved state, binding of the activatable antibody to PD-1 is reduced to occur with a dissociation constant that is at least 50-fold greater than the dissociation constant of an unmodified AB binding to PD-1, whereas in the cleaved state, the AB binds PD-1.

In some embodiments, the CM is positioned in the activatable antibody such that when the activatable antibody is in the uncleaved state, binding of the activatable antibody to PD-1 is reduced to occur with a dissociation constant that is at least 100-fold greater than the dissociation constant of an unmodified AB binding to PD-1, whereas in the cleaved state, the AB binds PD-1.

In some embodiments, the CM is positioned in the activatable antibody such that when the activatable antibody is in the uncleaved state, binding of the activatable antibody to PD-1 is reduced to occur with a dissociation constant that is at least 200-fold greater than the dissociation constant of an unmodified AB binding to PD-1, whereas in the cleaved state, the AB binds PD-1.

In some embodiments, the CM is a polypeptide of up to 15 amino acids in length.

In some embodiments, the CM is a polypeptide that includes a first cleavable moiety (CM1) that is a substrate for at least one matrix metalloprotease (MMP) and a second cleavable moiety (CM2) that is a substrate for at least one serine protease (SP). In some embodiments, each of the CM1 substrate sequence and the CM2 substrate sequence of the CM1-CM2 substrate is independently a polypeptide of up to 15 amino acids in length.

In some embodiments, the CM is a substrate for at least one protease that is or is believed to be up-regulated in cancer. In some embodiments, the CM is a substrate for at least one protease that is or is believed to be up-regulated in inflammation. In some embodiments, the CM is a substrate for at least one protease that is or is believed to be up-regulated in autoimmunity.

In some embodiments, the CM is a substrate for at least one protease selected from the group consisting of a matrix metalloprotease (MMP), thrombin, a neutrophil elastase, a cysteine protease, legumain, and a serine protease, such as matriptase (MT-SP1), and urokinase (uPA). Without being bound by theory, it is believed that these proteases are up-regulated in at least one of cancer, inflammation, and/or autoimmunity.

Exemplary substrates include but are not limited to substrates cleavable by one or more of the following enzymes or proteases listed in Table 3.

In some embodiments, the CM is selected for use with a specific protease, for example a protease that is known to be co-localized with the target of the activatable antibody. For example, the protease is produced by a tumor that is in proximity to T cells that express PD-1. In some embodiments, the protease is produced by a tumor that is co-localized with T cells that express PD-1.

In some embodiments, the CM is a substrate for at least one MMP. Examples of MMPs include the MMPs listed in the Table 3. In some embodiments, the CM is a substrate for a protease selected from the group consisting of MMP 9, MMPP14, MMP1, MMP3, MMP13, MMP17, MMP11, and MMP19. In some embodiments the CM is a substrate for MMP9. In some embodiments, the CM is a substrate for MMP14.

In some embodiments, the CM is a substrate that includes the sequence TGRGPSWV (SEQ ID NO: 295); SARGPSRW (SEQ ID NO: 319); TARGPSFK (SEQ ID NO: 297); LSGRSDNH (SEQ ID NO: 294); GGWHTGRN (SEQ ID NO: 320); HTGRSGAL (SEQ ID NO: 321); PLTGRSGG (SEQ ID NO: 296); AARGPAIH (SEQ ID NO: 322); RGPAFNPM (SEQ ID NO: 323); SSRGPAYL (SEQ ID NO: 324); RGPATPIM (SEQ ID NO: 325); RGPA (SEQ ID NO: 326); GGQPSGMWGW (SEQ ID NO: 327); FPRPLGITGL (SEQ ID NO: 328); VHMPLGFLGP (SEQ ID NO: 302); SPLTGRSG (SEQ ID NO: 329); SAGFSLPA (SEQ ID NO: 330); LAPLGLQRR (SEQ ID NO: 331); SGGPLGVR (SEQ ID NO: 332); PLGL (SEQ ID NO: 333); LSGRSGNH (SEQ ID NO: 1157); SGRSANPRG (SEQ ID NO: 1158); LSGRSDDH (SEQ ID NO: 1161); LSGRSDIH (SEQ ID NO: 1162); LSGRSDQH (SEQ ID NO: 1165); LSGRSDTH (SEQ ID NO: 1166); LSGRSDYH (SEQ ID NO: 1169); LSGRSDNP (SEQ ID NO: 1520); LSGRSANP (SEQ ID NO: 1695); LSGRSANI (SEQ ID NO: 1696); and/or LSGRSDNI (SEQ ID NO: 1697).

In some embodiments, the CM comprises the amino acid sequence LSGRSDNH (SEQ ID NO: 294). In some embodiments, the CM comprises the amino acid sequence TGRGPSWV (SEQ ID NO: 295). In some embodiments, the CM comprises the amino acid sequence PLTGRSGG (SEQ ID NO: 296). In some embodiments, the CM comprises the amino acid sequence GGQPSGMWGW (SEQ ID NO: 327). In some embodiments, the CM comprises the amino acid sequence FPRPLGITGL (SEQ ID NO: 328). In some embodiments, the CM comprises the amino acid sequence VHMPLGFLGP (SEQ ID NO: 302). In some embodiments, the CM comprises the amino acid sequence PLGL (SEQ ID NO: 333). In some embodiments, the CM comprises the amino acid sequence SARGPSRW (SEQ ID NO: 319). In some embodiments, the CM comprises the amino acid sequence TARGPSFK (SEQ ID NO: 297). In some embodiments, the CM comprises the amino acid sequence GGWHTGRN (SEQ ID NO: 320). In some embodiments, the CM comprises the amino acid sequence HTGRSGAL (SEQ ID NO: 321). In some embodiments, the CM comprises the amino acid sequence AARGPAIH (SEQ ID NO: 322). In some embodiments, the CM comprises the amino acid sequence RGPAFNPM (SEQ ID NO: 323). In some embodiments, the CM comprises the amino acid sequence SSRGPAYL (SEQ ID NO: 324). In some embodiments, the CM comprises the amino acid sequence RGPATPIM (SEQ ID NO: 325). In some embodiments, the CM comprises the amino acid sequence RGPA (SEQ ID NO: 326). In some embodiments, the CM comprises the amino acid sequence LSGRSGNH (SEQ ID NO: 1157). In some embodiments, the CM comprises the amino acid sequence SGRSANPRG (SEQ ID NO: 1158). In some embodiments, the CM comprises the amino acid sequence LSGRSDDH (SEQ ID NO: 1161). In some embodiments, the CM comprises the amino acid sequence LSGRSDIH (SEQ ID NO: 1162). In some embodiments, the CM comprises the amino acid sequence LSGRSDQH (SEQ ID NO: 1165). In some embodiments, the CM comprises the amino acid sequence LSGRSDTH (SEQ ID NO: 1166). In some embodiments, the CM comprises the amino acid sequence LSGRSDYH (SEQ ID NO: 1169). In some embodiments, the CM comprises the amino acid sequence LSGRSDNP (SEQ ID NO: 1520). In some embodiments, the CM comprises the amino acid sequence LSGRSANP (SEQ ID NO: 1695). In some embodiments, the CM comprises the amino acid sequence LSGRSANI (SEQ ID NO: 1696). In some embodiments, the CM comprises the amino acid sequence LSGRSDNI (SEQ ID NO: 1697).

In some embodiments, the CM is a substrate for an MMP and includes the sequence ISSGLSS (SEQ ID NO: 334); QNQALRMA (SEQ ID NO: 305); AQNLLGMV (SEQ ID NO: 304); STFPFGMF (SEQ ID NO: 307); PVGYTSSL (SEQ ID NO: 335); DWLYWPGI (SEQ ID NO: 336), ISSGLLSS (SEQ ID NO: 308), LKAAPRWA (SEQ ID NO: 337); GPSHLVLT (SEQ ID NO: 338); LPGGLSPW (SEQ ID NO: 339); MGLFSEAG (SEQ ID NO: 340); SPLPLRVP (SEQ ID NO: 341); RMHLRSLG (SEQ ID NO: 342); LAAPLGLL (SEQ ID NO: 306); AVGLLAPP (SEQ ID NO: 303); LLAPSHRA (SEQ ID NO: 343); PAGLWLDP (SEQ ID NO: 309); MIAPVAYR (SEQ ID NO: 1698); RPSPMWAY (SEQ ID NO: 1699); WATPRPMR (SEQ ID NO: 1700); FRLLDWQW (SEQ ID NO: 1701); ISSGL (SEQ ID NO: 1702); ISSGLLS (SEQ ID NO: 1703); and/or ISSGLL (SEQ ID NO: 1704).

In some embodiments, the CM comprises the amino acid sequence ISSGLSS (SEQ ID NO: 334). In some embodiments, the CM comprises the amino acid sequence QNQALRMA (SEQ ID NO: 305). In some embodiments, the CM comprises the amino acid sequence AQNLLGMV (SEQ ID NO: 304). In some embodiments, the CM comprises the amino acid sequence STFPFGMF (SEQ ID NO: 307). In some embodiments, the CM comprises the amino acid sequence PVGYTSSL (SEQ ID NO: 335). In some embodiments, the CM comprises the amino acid sequence DWLYWPGI (SEQ ID NO: 336). In some embodiments, the CM comprises the amino acid sequence ISSGLLSS (SEQ ID NO: 308). In some embodiments, the CM comprises the amino acid sequence LKAAPRWA (SEQ ID NO: 337). In some embodiments, the CM comprises the amino acid sequence GPSHLVLT (SEQ ID NO: 338). In some embodiments, the CM comprises the amino acid sequence LPGGLSPW (SEQ ID NO: 339). In some embodiments, the CM comprises the amino acid sequence MGLFSEAG (SEQ ID NO: 340). In some embodiments, the CM comprises the amino acid sequence SPLPLRVP (SEQ ID NO: 341). In some embodiments, the CM comprises the amino acid sequence RMHLRSLG (SEQ ID NO: 342). In some embodiments, the CM comprises the amino acid sequence LAAPLGLL (SEQ ID NO: 306). In some embodiments, the CM comprises the amino acid sequence AVGLLAPP (SEQ ID NO: 303). In some embodiments, the CM comprises the amino acid sequence LLAPSHRA (SEQ ID NO: 343). In some embodiments, the CM comprises the amino acid sequence PAGLWLDP (SEQ ID NO: 309). In some embodiments, the CM comprises the amino acid sequence MIAPVAYR (SEQ ID NO: 1698). In some embodiments, the CM comprises the amino acid sequence RPSPMWAY (SEQ ID NO: 1699). In some embodiments, the CM comprises the amino acid sequence WATPRPMR (SEQ ID NO: 1700). In some embodiments, the CM comprises the amino acid sequence FRLLDWQW (SEQ ID NO: 1701). In some embodiments, the CM comprises the amino acid sequence ISSGL (SEQ ID NO: 1702). In some embodiments, the CM comprises the amino acid sequence ISSGLLS (SEQ ID NO: 1703). In some embodiments, the CM comprises the amino acid sequence ISSGLL (SEQ ID NO: 1704).

In some embodiments, the CM is a substrate for thrombin. In some embodiments, the CM is a substrate for thrombin and includes the sequence GPRSFGL (SEQ ID NO: 344) or GPRSFG (SEQ ID NO: 345). In some embodiments, the CM comprises the amino acid sequence GPRSFGL (SEQ ID NO: 344). In some embodiments, the CM comprises the amino acid sequence GPRSFG (SEQ ID NO: 345).

In some embodiments, the CM comprises an amino acid sequence selected from the group consisting of NTLSGRSENHSG (SEQ ID NO: 298); NTLSGRSGNHGS (SEQ ID NO: 299); TSTSGRSANPRG (SEQ ID NO: 300); TSGRSANP (SEQ ID NO: 301); VAGRSMRP (SEQ ID NO: 310); VVPEGRRS (SEQ ID NO: 311); ILPRSPAF (SEQ ID NO: 312); MVLGRSLL (SEQ ID NO: 313); QGRAITFI (SEQ ID NO: 314); SPRSIMLA (SEQ ID NO: 315); and SMLRSMPL (SEQ ID NO: 316).

In some embodiments, the CM comprises the amino acid sequence NTLSGRSENHSG (SEQ ID NO: 298). In some embodiments, the CM comprises the amino acid sequence NTLSGRSGNHGS (SEQ ID NO: 299). In some embodiments, the CM comprises the amino acid sequence TSTSGRSANPRG (SEQ ID NO: 300). In some embodiments, the CM comprises the amino acid sequence TSGRSANP (SEQ ID NO: 301). In some embodiments, the CM comprises the amino acid sequence VAGRSMRP (SEQ ID NO: 310). In some embodiments, the CM comprises the amino acid sequence VVPEGRRS (SEQ ID NO: 311). In some embodiments, the CM comprises the amino acid sequence ILPRSPAF (SEQ ID NO: 312). In some embodiments, the CM comprises the amino acid sequence MVLGRSLL (SEQ ID NO: 313). In some embodiments, the CM comprises the amino acid sequence QGRAITFI (SEQ ID NO: 314). In some embodiments, the CM comprises the amino acid sequence SPRSIMLA (SEQ ID NO: 315). In some embodiments, the CM comprises the amino acid sequence SMLRSMPL (SEQ ID NO: 316).

In some embodiments, the CM comprises an amino acid sequence selected from the group consisting of SEQ ID NOs: 214, 294-361, 1092-1112, 1157, 1158, 1161, 1162, 1165, 1166, 1169, 1520, and 1695-1704. In some embodiments, the CM comprises an amino acid sequence selected from the group consisting of SEQ ID NOs: 214, 294, 300, 302, 303, 305, 308, 318, 347, 361, 1092-1102, 1111, and 1157.

In some embodiments, the CM is a substrate for a neutrophil elastase. In some embodiments, the CM is a substrate for a serine protease. In some embodiments, the CM is a substrate for uPA. In some embodiments, the CM is a substrate for legumain. In some embodiments, the CM is a substrate for matriptase. In some embodiments, the CM is a substrate for a cysteine protease. In some embodiments, the CM is a substrate for a cysteine protease, such as a cathepsin.

In some embodiments, the CM is a CM1-CM2 substrate and includes the sequence ISSGLLSGRSDNH (SEQ ID NO: 214); ISSGLLSSGGSGGSLSGRSDNH (SEQ ID NO: 346); AVGLLAPPGGTSTSGRSANPRG (SEQ ID NO: 347); TSTSGRSANPRGGGAVGLLAPP (SEQ ID NO: 348); VHMPLGFLGPGGTSTSGRSANPRG (SEQ ID NO: 349); TSTSGRSANPRGGGVHMPLGFLGP (SEQ ID NO: 350); AVGLLAPPGGLSGRSDNH (SEQ ID NO: 318); LSGRSDNHGGAVGLLAPP (SEQ ID NO: 351); VHMPLGFLGPGGLSGRSDNH (SEQ ID NO: 352); LSGRSDNHGGVHMPLGFLGP (SEQ ID NO: 353); LSGRSDNHGGSGGSISSGLLSS (SEQ ID NO: 354); LSGRSGNHGGSGGSISSGLLSS (SEQ ID NO: 355); ISSGLLSSGGSGGSLSGRSGNH (SEQ ID NO: 356); LSGRSDNHGGSGGSQNQALRMA (SEQ ID NO: 357); QNQALRMAGGSGGSLSGRSDNH (SEQ ID NO: 358); LSGRSGNHGGSGGSQNQALRMA (SEQ ID NO: 359); QNQALRMA GGS GGSLSGRSGNH (SEQ ID NO: 360); ISSGLLSGRSGNH (SEQ ID NO: 361); ISSGLLSGRSANPRG (SEQ ID NO: 1092); AVGLLAPPTSGRSANPRG (SEQ ID NO: 1093); AVGLLAPPSGRSANPRG (SEQ ID NO: 1094); ISSGLLSGRSDDH (SEQ ID NO: 1095); ISSGLLSGRSDIH (SEQ ID NO: 1096); ISSGLLSGRSDQH (SEQ ID NO: 1097); ISSGLLSGRSDTH (SEQ ID NO: 1098); ISSGLLSGRSDYH (SEQ ID NO: 1099); ISSGLLSGRSDNP (SEQ ID NO: 1100); ISSGLLSGRSANP (SEQ ID NO: 1101); ISSGLLSGRSANI (SEQ ID NO: 1102); AVGLLAPPGGLSGRSDDH (SEQ ID NO: 1103); AVGLLAPPGGLSGRSDIH (SEQ ID NO: 1104); AVGLLAPPGGLSGRSDQH (SEQ ID NO: 1105); AVGLLAPPGGLSGRSDTH (SEQ ID NO: 1106); AVGLLAPPGGLSGRSDYH (SEQ ID NO: 1107); AVGLLAPPGGLSGRSDNP (SEQ ID NO: 1108); AVGLLAPPGGLSGRSANP (SEQ ID NO: 1109); AVGLLAPPGGLSGRSANI (SEQ ID NO: 1110); ISSGLLSGRSDNI (SEQ ID NO: 1111); and/or AVGLLAPPGGLSGRSDNI (SEQ ID NO: 1112).

In some embodiments, the CM1-CM2 substrate includes the sequence ISSGLLSGRSDNH (SEQ ID NO: 214), which is also referred to herein as substrate 2001. In some embodiments, the CM1-CM2 substrate includes the sequence ISSGLLSSGGSGGSLSGRSDNH (SEQ ID NO: 346), which is also referred to herein as substrate 1001/LP'/0001, where LP' as used in this CM1-CM2 substrate is the amino acid sequence GGSGGS (SEQ ID NO: 1519). In some embodiments, the CM1-CM2 substrate includes the sequence AVGLLAPPGGTSTSGRSANPRG (SEQ ID NO: 347), which is also referred to herein as substrate 1004/LP'/0003, where LP' as used in this CM1-CM2 substrate is the amino acid sequence GG. In some embodiments, the CM1-CM2 substrate includes the sequence TSTSGRSANPRGGG AVGLLAPP (SEQ ID NO: 348), which is also referred to herein as substrate 0003/LP'/1004, where LP' as used in this CM1-CM2 substrate is the amino acid sequence GG. In some embodiments, the CM1-CM2 substrate includes the sequence VHMPLGFLGPGGTSTSGRSANPRG (SEQ ID NO: 349), which is also referred to herein as substrate 1003/LP'/0003, where LP' as used in this CM1-CM2 substrate is the amino acid sequence GG. In some embodiments, the CM1-CM2 substrate includes the sequence TSTSGR-SANPRGGGVHMPLGFLGP (SEQ ID NO: 350), which is also referred to herein as substrate 0003/LP'/1003, where LP' as used in this CM1-CM2 substrate is the amino acid sequence GG. In some embodiments, the CM1-CM2 substrate includes the sequence AVGLLAPPGGLSGRSDNH (SEQ ID NO: 318), which is also referred to herein as substrate 1004/LP'/0001, where LP' as used in this CM1-CM2 substrate is the amino acid sequence GG. In some embodiments, the CM1-CM2 substrate includes the sequence LSGRSDNHGGAVGLLAPP (SEQ ID NO: 351), which is also referred to herein as substrate 0001/LP'/1004, where LP' as used in this CM1-CM2 substrate is the amino acid sequence GG. In some embodiments, the CM1-CM2 substrate includes the sequence VHMPLGFLGPGGLS-GRSDNH (SEQ ID NO: 352), which is also referred to herein as substrate 1003/LP'/0001, where LP' as used in this CM1-CM2 substrate is the amino acid sequence GG. In some embodiments, the CM1-CM2 substrate includes the sequence LSGRSDNHGGVHMPLGFLGP (SEQ ID NO: 353), which is also referred to herein as substrate 0001/LP'/1003, where LP' as used in this CM1-CM2 substrate is the amino acid sequence GG. In some embodiments, the CM1-CM2 substrate includes the sequence LSGRSDNHGGSGG-SISSGLLSS (SEQ ID NO: 354), which is also referred to herein as substrate 0001/LP'/1001, where LP' as used in this CM1-CM2 substrate is the amino acid sequence GGSGGS (SEQ ID NO: 1519). In some embodiments, the CM1-CM2 substrate includes the sequence LSGRSGNHGGSGGSISS-GLLSS (SEQ ID NO: 355), which is also referred to herein as substrate 0002/LP'/1001, where LP' as used in this CM1-CM2 substrate is the amino acid sequence GGSGGS (SEQ ID NO: 1519). In some embodiments, the CM1-CM2 substrate includes the sequence ISSGLLSSGGSGGSLS-GRSGNH (SEQ ID NO: 356), which is also referred to herein as substrate 1001/LP'/0002, where LP' as used in this CM1-CM2 substrate is the amino acid sequence GGSGGS (SEQ ID NO: 1519). In some embodiments, the CM1-CM2 substrate includes the sequence LSGRSDNHGGSGGSQN-QALRMA (SEQ ID NO: 357), which is also referred to herein as substrate 0001/LP'/1002, where LP' as used in this CM1-CM2 substrate is the amino acid sequence GGSGGS (SEQ ID NO: 1519). In some embodiments, the CM1-CM2 substrate includes the sequence QNQALRMAGGSGGSLS-GRSDNH (SEQ ID NO: 358), which is also referred to herein as substrate 1002/LP'/0001, where LP' as used in this CM1-CM2 substrate is the amino acid sequence GGSGGS (SEQ ID NO: 1519). In some embodiments, the CM1-CM2 substrate includes the sequence LSGRSGNHGGSGGSQN-QALRMA (SEQ ID NO: 359), which is also referred to herein as substrate 0002/LP'/1002, where LP' as used in this CM1-CM2 substrate is the amino acid sequence GGSGGS (SEQ ID NO: 1519). In some embodiments, the CM1-CM2 substrate includes the sequence QNQALRMAGGSGGSLS-GRSGNH (SEQ ID NO: 360), which is also referred to herein as substrate 1002/LP'/0002, where LP' as used in this CM1-CM2 substrate is the amino acid sequence GGSGGS (SEQ ID NO: 1519). In some embodiments, the CM1-CM2 substrate includes the sequence ISSGLLSGRSGNH (SEQ ID NO: 361), which is also referred to herein as substrate 2002. In some embodiments, the CM1-CM2 substrate includes the sequence ISSGLLSGRSANPRG (SEQ ID NO: 1092), which is also referred to herein as substrate 2003. In some embodiments, the CM1-CM2 substrate includes the sequence AVGLLAPPTSGRSANPRG (SEQ ID NO: 1093), which is also referred to herein as substrate 2004. In some embodiments, the CM1-CM2 substrate includes the sequence AVGLLAPPSGRSANPRG (SEQ ID NO: 1094), which is also referred to herein as substrate 2005. In some embodiments, the CM1-CM2 substrate includes the sequence ISSGLLSGRSDDH (SEQ ID NO: 1095), which is also referred to herein as substrate 2006. In some embodiments, the CM1-CM2 substrate includes the sequence ISSGLLSGRSDIH (SEQ ID NO: 1096), which is also referred to herein as substrate 2007. In some embodiments, the CM1-CM2 substrate includes the sequence ISSGLLSGRSDQH (SEQ ID NO: 1097), which is also referred to herein as substrate 2008. In some embodiments, the CM1-CM2 substrate includes the sequence ISSGLLSGRSDTH (SEQ ID NO: 1098), which is also referred to herein as substrate 2009. In some embodiments, the CM1-CM2 substrate includes the sequence ISSGLLSGRSDYH (SEQ ID NO: 1099), which is also referred to herein as substrate 2010. In some embodiments, the CM1-CM2 substrate includes the sequence ISSGLLSGRSDNP (SEQ ID NO: 1100), which is also referred to herein as substrate 2011. In some embodiments, the CM1-CM2 substrate includes the sequence ISSGLLSGRSANP (SEQ ID NO: 1101), which is also referred to herein as substrate 2012. In some embodiments, the CM1-CM2 substrate includes the sequence ISSGLLSGR-SANI (SEQ ID NO: 1102), which is also referred to herein as substrate 2013. In some embodiments, the CM1-CM2 substrate includes the sequence AVGLLAPPGGLS-GRSDDH (SEQ ID NO: 1103), which is also referred to herein as substrate 3006. In some embodiments, the CM1-CM2 substrate includes the sequence AVGLLAPPGGLS-GRSDIH (SEQ ID NO: 1104), which is also referred to herein as substrate 3007. In some embodiments, the CM1-CM2 substrate includes the sequence AVGLLAPPGGLS-GRSDQH (SEQ ID NO: 1105), which is also referred to herein as substrate 3008. In some embodiments, the CM1-CM2 substrate includes the sequence AVGLLAPPGGLS-GRSDTH (SEQ ID NO: 1106), which is also referred to herein as substrate 3009. In some embodiments, the CM1-CM2 substrate includes the sequence AVGLLAPPGGLS-GRSDYH (SEQ ID NO: 1107), which is also referred to herein as substrate 3010. In some embodiments, the CM1-CM2 substrate includes the sequence AVGLLAPPGGLS-GRSDNP (SEQ ID NO: 1108), which is also referred to herein as substrate 3011. In some embodiments, the CM1-CM2 substrate includes the sequence AVGLLAPPGGLS-GRSANP (SEQ ID NO: 1109), which is also referred to herein as substrate 3012. In some embodiments, the CM1-CM2 substrate includes the sequence AVGLLAPPGGLS- GRSANI (SEQ ID NO: 1110), which is also referred to herein as substrate 3013. In some embodiments, the CM1-CM2 substrate includes the sequence ISSGLLSGRSDNI (SEQ ID NO: 1111), which is also referred to herein as substrate 2014. In some embodiments, the CM1-CM2 substrate includes the sequence and/or AVGLLAPPGGLSGRS-DNI (SEQ ID NO: 1112), which is also referred to herein as substrate 3014. In some embodiments, the CM1-CM2 substrate includes the sequence GLSGRSDNHGGAVGLLAPP (SEQ ID NO: 1970), which is also referred to herein as substrate 0001/LP'/1004, where LP' as used in this CM1-CM2 substrate is the amino acid sequence GG. In some embodiments, the CM1-CM2 substrate includes the sequence GLSGRSDNHGGVHMPLGFLGP (SEQ ID NO: 1971), which is also referred to herein as substrate 0001/LP'/1003, where LP' as used in this CM1-CM2 substrate is the amino acid sequence GG.

In some embodiments, the CM is a substrate for at least two proteases. In some embodiments, each protease is selected from the group consisting of those shown in Table 3. In some embodiments, the CM is a substrate for at least two proteases, wherein one of the proteases is selected from the group consisting of a MMP, thrombin, a neutrophil elastase, a cysteine protease, uPA, legumain and matriptase and the other protease is selected from the group consisting of those shown in Table 3. In some embodiments, the CM is a substrate for at least two proteases selected from the group consisting of a MMP, thrombin, a neutrophil elastase, a cysteine protease, uPA, legumain and matriptase.

In some embodiments, the activatable antibody includes at least a first CM and a second CM. In some embodiments, the first CM and the second CM are each polypeptides of no more than 15 amino acids long. In some embodiments, the first CM and the second CM in the activatable antibody in the uncleaved state have the structural arrangement from N-terminus to C-terminus as follows: MM-CM1-CM2-AB or AB-CM2-CM1-MM. In some embodiments, at least one of the first CM and the second CM is a polypeptide that functions as a substrate for a protease selected from the group consisting of a MMP, thrombin, a neutrophil elastase, a cysteine protease, uPA, legumain, and matriptase. In some embodiments, the first CM is cleaved by a first cleaving agent selected from the group consisting of a MMP, thrombin, a neutrophil elastase, a cysteine protease, uPA, legumain, and matriptase in a target tissue and the second CM is cleaved by a second cleaving agent in a target tissue. In some embodiments, the other protease is selected from the group consisting of those shown in Table 3. In some embodiments, the first cleaving agent and the second cleaving agent are the same protease selected from the group consisting of a MMP, thrombin, a neutrophil elastase, a cysteine protease, uPA, legumain, and matriptase, and the first CM and the second CM are different substrates for the enzyme. In some embodiments, the first cleaving agent and the second cleaving agent are the same protease selected from the group consisting of those shown in Table 3. In some embodiments, the first cleaving agent and the second cleaving agent are different proteases. In some embodiments, the first cleaving agent and the second cleaving agent are co-localized in the target tissue. In some embodiments, the first CM and the second CM are cleaved by at least one cleaving agent in the target tissue.

In some embodiments, the activatable antibody is exposed to and cleaved by a protease such that, in the activated or cleaved state, the activated antibody includes a light chain amino acid sequence that includes at least a portion of LP2 and/or CM sequence after the protease has cleaved the CM.

In some embodiments, the activatable antibody also includes an agent conjugated to the AB. In some embodiments, the agent conjugated to the AB or the AB of an activatable antibody is a therapeutic agent. In some embodiments, the agent is conjugated to the AB via a cleavable linker. In some embodiments, the agent is conjugated to the AB via a linker that includes at least one CM1-CM2 substrate sequence. In some embodiments, the agent is conjugated to the AB via a noncleavable linker.

In some embodiments, the agent is an anti-inflammatory agent.

In some embodiments, the activatable antibody also includes a detectable moiety. In some embodiments, the detectable moiety is a diagnostic agent.

In some embodiments, the activatable antibody also includes a signal peptide. In some embodiments, the signal peptide is conjugated to the activatable antibody via a spacer. In some embodiments, the spacer is conjugated to the activatable antibody in the absence of a signal peptide. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. An example of a spacer joined directly to the N-terminus of MM of the activatable antibody is selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. Additional examples of spacers include GQSGQG (SEQ ID NO: 2042), QSGQG (SEQ ID NO: 2043), SGQG (SEQ ID NO: 2044), GQG (SEQ ID NO: 2045), QG (SEQ ID NO: 2046), and G. In some embodiments, the spacer includes at least the amino acid sequence QGQSGQG (SEQ ID NO: 362). In some embodiments, the spacer includes at least the amino acid sequence QGQSGQ (SEQ ID NO: 913). In some embodiments, the spacer includes at least the amino acid sequence QGQSG (SEQ ID NO: 914). In some embodiments, the spacer includes at least the amino acid sequence QGQS (SEQ ID NO: 915), In some embodiments, the spacer includes at least the amino acid sequence QGQ (SEQ ID NO: 916). In some embodiments, the spacer includes at least the amino acid sequence QG (SEQ ID NO: 917). In some embodiments, the spacer includes at least the amino acid residue Q. In some embodiments, the spacer includes at least the amino acid sequence GQSGQG (SEQ ID NO: 2042). In some embodiments, the spacer includes at least the amino acid sequence QSGQG (SEQ ID NO: 2043). In some embodiments, the spacer includes at least the amino acid sequence SGQG (SEQ ID NO: 2044). In some embodiments, the spacer includes at least the amino acid sequence GQG (SEQ ID NO: 2045). In some embodiments, the spacer includes at least the amino acid sequence QG (SEQ ID NO: 2046). In some embodiments, the spacer includes at least the amino acid sequence G. In some embodiments, the activatable antibody does not include a spacer sequence.

In some embodiments, the AB of the activatable antibody naturally contains one or more disulfide bonds. In some embodiments, the AB can be engineered to include one or more disulfide bonds.

In some embodiments, the serum half-life of the activatable antibody is longer than that of the corresponding antibody; e.g., the pK of the activatable antibody is longer than that of the corresponding antibody. In some embodiments, the serum half-life of the activatable antibody is similar to that of the corresponding antibody. In some embodiments, the serum half-life of the activatable antibody is at least 15 days when administered to an organism. In some embodiments, the serum half-life of the activatable antibody is at least 12 days when administered to an organism. In some embodiments, the serum half-life of the activatable antibody is at least 11 days when administered to an organism. In some embodiments, the serum half-life of the activatable antibody is at least 10 days when administered to an organism. In some embodiments, the serum half-life of the activatable antibody is at least 9 days when administered to an organism. In some embodiments, the serum half-life of the activatable antibody is at least 8 days when administered to an organism. In some embodiments, the serum half-life of the activatable antibody is at least 7 days when administered to an organism. In some embodiments, the serum half-life of the activatable antibody is at least 6 days when administered to an organism. In some embodiments, the serum half-life of the activatable antibody is at least 5 days when administered to an organism. In some embodiments, the serum half-life of the activatable antibody is at least 4 days when administered to an organism. In some embodiments, the serum half-life of the activatable antibody is at least 3 days when administered to an organism. In some embodiments, the serum half-life of the activatable antibody is at least 2 days when administered to an organism. In some embodiments, the serum half-life of the activatable antibody is at least 24 hours when administered to an organism. In some embodiments, the serum half-life of the activatable antibody is at least 20 hours when administered to an organism. In some embodiments, the serum half-life of the activatable antibody is at least 18 hours when administered to an organism. In some embodiments, the serum half-life of the activatable antibody is at least 16 hours when administered to an organism. In some embodiments, the serum half-life of the activatable antibody is at least 14 hours when administered to an organism. In some embodiments, the serum half-life of the activatable antibody is at least 12 hours when administered to an organism. In some embodiments, the serum half-life of the activatable antibody is at least 10 hours when administered to an organism. In some embodiments, the serum half-life of the activatable antibody is at least 8 hours when administered to an organism. In some embodiments, the serum half-life of the activatable antibody is at least 6 hours when administered to an organism. In some embodiments, the serum half-life of the activatable antibody is at least 4 hours when administered to an organism. In some embodiments, the serum half-life of the activatable antibody is at least 3 hours when administered to an organism.

In some embodiments, the activatable anti-PD-1 antibody is monospecific.

In some embodiments, the activatable anti-PD-1 antibody is multispecific, e.g., by way of non-limiting example, bispecific or trifunctional. In some embodiments, the activatable anti-PD-1 antibody is formulated as part of a pro-Bispecific T Cell Engager (BITE) molecule, i.e., the BITE includes a masking moiety and a cleavable moiety. In some embodiments, the activatable anti-PD-1 antibody is formulated as part of a pro-Chimeric Antigen Receptor (CAR) modified T cell, modified NK cell, or other modified immune effector cell. In some embodiments, an activatable anti-PD-1 antibody is formulated as part of another engineered receptor on an immune effector cell; i.e., the pro-CAR or other pro-engineered receptor includes a masking moiety and a cleavable moiety.

In some embodiments, the activatable antibody or antigen-binding fragment thereof is incorporated in a multispecific activatable antibody or antigen-binding fragment thereof, where at least one arm of the multispecific activatable antibody specifically binds PD-1. In some embodiments, the activatable antibody or antigen-binding fragment thereof is incorporated in a bispecific activatable antibody or antigen-binding fragment thereof, where at least one arm of the bispecific activatable antibody specifically binds PD-1.

In some embodiments, at least one arm of the multispecific activatable antibody, e.g., a bispecific activatable antibody, comprises a heavy chain amino acid sequence selected from the group consisting of SEQ ID NO: 1, 5, 9, 13, 17, 21, 23, 25, 27, 29, 31, 33, 35, and 37. In some embodiments, at least one arm of the multispecific activatable antibody, e.g., a bispecific activatable antibody, comprises a heavy chain amino acid sequence selected from the group consisting of SEQ ID NO: 21, 23, 25, 27, 29, 31, 33, 35, and 37.

In some embodiments, at least one arm of the multispecific activatable antibody, e.g., a bispecific activatable antibody, comprises a light chain amino acid sequence selected from the group consisting of SEQ ID NO: 3, 7, 11, 15, 19, 39, 41, 43, 45, 47, 49, 51, 53, 55, 57, and 59. In some embodiments, at least one arm of the multispecific activatable antibody, e.g., a bispecific activatable antibody, comprises a light chain amino acid sequence selected from the group consisting of SEQ ID NO: 39, 41, 43, 45, 47, 49, 51, 53, 55, 57, and 59.

In some embodiments, at least one arm of the multispecific activatable antibody, e.g., a bispecific activatable antibody, a heavy chain amino acid sequence comprising an amino acid sequence selected from the group consisting of SEQ ID NO: 1, 5, 9, 13, 17, 21, 23, 25, 27, 29, 31, 33, 35, and 37, and a light chain amino acid sequence selected from the group consisting of SEQ ID NO: 3, 7, 11, 15, 19, 39, 41, 43, 45, 47, 49, 51, 53, 55, 57, and 59. In some embodiments, at least one arm of the multispecific activatable antibody, e.g., a bispecific activatable antibody, a heavy chain amino acid sequence comprising an amino acid sequence selected from the group consisting of SEQ ID NO: 21, 23, 25, 27, 29, 31, 33, 35, and 37, and a light chain amino acid sequence selected from the group consisting of SEQ ID NO: 39, 41, 43, 45, 47, 49, 51, 53, 55, 57, and 59. In some embodiments, at least one arm of the multispecific activatable antibody, e.g., a bispecific activatable antibody, includes a heavy chain that comprises or is derived from amino acid sequence SEQ ID NO: 21. In some embodiments, at least one arm of the multispecific activatable antibody, e.g., a bispecific activatable antibody, includes a light chain that comprises or is derived from amino acid sequence SEQ ID NO: 45 or SEQ ID NO: 47. In some embodiments, at least one arm of the multispecific activatable antibody, e.g., a bispecific activatable antibody, includes a heavy chain that comprises or is derived from amino acid sequence SEQ ID NO: 21 and a light chain that comprises or is derived from amino acid sequence SEQ ID NO: 45 or SEQ ID NO: 47. In some embodiments, at least one arm of the multispecific activatable antibody, e.g., a bispecific activatable antibody, includes a heavy chain that comprises or is derived from amino acid sequence SEQ ID NO: 21 and a light chain that comprises or is derived from amino acid sequence SEQ ID NO: 45. In some embodiments, at least one arm of the multispecific activatable antibody, e.g., a bispecific activatable antibody, includes a heavy chain that comprises or is derived from amino acid sequence SEQ ID NO: 21 and a light chain that comprises or is derived from amino acid sequence SEQ ID NO: 47.

In some embodiments, at least one arm of the multispecific activatable antibody, e.g., a bispecific activatable antibody, includes the combination of the complementarity determining region (CDR) sequences of the heavy chain amino acid sequence of SEQ ID NO: 21. In some embodiments, at least one arm of the multispecific activatable antibody, e.g., a bispecific activatable antibody, includes the combination of the CDR sequences of the light chain amino acid sequence of SEQ ID NO: 45 or of SEQ ID NO: 47. In some embodiments, at least one arm of the multispecific activatable antibody, e.g., a bispecific activatable antibody, includes a combination of the CDR sequences of the heavy chain amino acid sequence of SEQ ID NO: 21, and the CDR sequences of the light chain amino acid sequence of SEQ ID NO: 45 or 47. In some embodiments, at least one arm of the multispecific activatable antibody, e.g., a bispecific activatable antibody, includes a combination of the CDR sequences of the heavy chain amino acid sequence of SEQ ID NO: 21, and the CDR sequences of the light chain amino acid sequence of SEQ ID NO: 45. In some embodiments, at least one arm of the multispecific activatable antibody, e.g., a bispecific activatable antibody, includes a combination of the CDR sequences of the heavy chain amino acid sequence of SEQ ID NO: 21, and the CDR sequences of the light chain amino acid sequence of SEQ ID NO: 47.

In some embodiments, at least one arm of the multispecific activatable antibody, e.g., a bispecific activatable antibody includes: (a) a variable heavy chain complementarity determining region 1 (VH CDR1) comprising an amino acid sequence selected from the group consisting of SEQ ID NOs: 653-657; (b) a variable heavy chain complementarity determining region 2 (VH CDR2) comprising an amino acid sequence selected from the group consisting of SEQ ID NOs: 658-663; (c) a variable heavy chain complementarity determining region 3 (VH CDR3) comprising an amino acid sequence selected from the group consisting of SEQ ID NOs: 664-668; (d) a variable light chain complementarity determining region 1 (VL CDR1) comprising an amino acid sequence selected from the group consisting of SEQ ID NOs:669-677; (e) a variable light chain complementarity determining region 2 (VL CDR2) comprising an amino acid sequence selected from the group consisting of SEQ ID NOs: 678-682; and (f) variable light chain complementarity determining region 3 (VL CDR3) comprising an amino acid sequence selected from the group consisting of SEQ ID NOs: 683-687

In some embodiments, at least one arm of the multispecific activatable antibody, e.g., a bispecific activatable antibody, includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664).

In some embodiments, at least one arm of the multispecific activatable antibody, e.g., a bispecific activatable antibody, includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, at least one arm of the multispecific activatable antibody, e.g., a bispecific activatable antibody, includes a combination of a VL CDR1 sequence, a VL CDR2 sequence, and a VL CDR3 sequence, wherein the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, at least one arm of the multispecific activatable antibody, e.g., a bispecific activatable antibody, includes a combination of a VL CDR1 sequence, a VL CDR2 sequence, and a VL CDR3 sequence, wherein the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, at least one arm of the multispecific activatable antibody, e.g., a bispecific activatable antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675) or RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683). In some embodiments, at least one arm of the multispecific activatable antibody, e.g., a bispecific activatable antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDSYGISFMN (SEQ ID NO: 675); the VL CDR2 sequence comprises AASNQGS (SEQ ID NO: 678); and the VL CDR3 sequence comprises QQSKDVPWT (SEQ ID NO: 683). In some embodiments, at least one arm of the multispecific activatable antibody, e.g., a bispecific activatable antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GFTFSGYAMS (SEQ ID NO: 653); the VH CDR2 sequence comprises YISNSGGNAH (SEQ ID NO: 658); and the VH CDR3 sequence comprises EDYGTSPFVY (SEQ ID NO: 664); the VL CDR1 sequence comprises RASESVDAYGISFMN (SEQ ID NO:676); the VL CDR2 sequence comprises AASNQGS (SEQ ID NO: 678); and the VL CDR3 sequence comprises QQSKDVPWT (SEQ ID NO: 683).

In some embodiments, at least one arm of the multispecific activatable antibody, e.g., a bispecific activatable antibody, includes a heavy chain that comprises or is derived from the amino acid sequence of SEQ ID NO: 1346, and a light chain that comprises or is derived from the amino acid sequence of SEQ ID NO: 626.

In some embodiments, at least one arm of the multispecific activatable antibody, e.g., a bispecific activatable antibody, includes a heavy chain that comprises or is derived from the amino acid sequence of SEQ ID NO: 1514, and a light chain that comprises or is derived from the amino acid sequence of SEQ ID NO: 638.

In some embodiments, at least one arm of the multispecific activatable antibody, e.g., a bispecific activatable antibody, includes the combination of the complementarity determining region (CDR) sequences of the heavy chain amino acid sequence of SEQ ID NO: 1346. In some embodiments, at least one arm of the multispecific activatable antibody, e.g., a bispecific activatable antibody, includes the combination of the CDR sequences of the light chain amino acid sequence of SEQ ID NO: 626. In some embodiments, at least one arm of the multispecific activatable antibody, e.g., a bispecific activatable antibody, includes a combination of the CDR sequences of the heavy chain amino acid sequence of SEQ ID NO: 1346, and the CDR sequences of the light chain amino acid sequence of SEQ ID NO: 626.

In some embodiments, at least one arm of the multispecific activatable antibody, e.g., a bispecific activatable antibody, includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GITFSNSG (SEQ ID NO: 1705); the VH CDR2 sequence comprises IWYDGSKR (SEQ ID NO: 1706); and the VH CDR3 sequence comprises TNDDY (SEQ ID NO: 1707).

In some embodiments, at least one arm of the multispecific activatable antibody, e.g., a bispecific activatable antibody, includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, at least one arm of the multispecific activatable antibody, e.g., a bispecific activatable antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GITFSNSG (SEQ ID NO: 1705); the VH CDR2 sequence comprises IWYDGSKR (SEQ ID NO: 1706); the VH CDR3 sequence comprises TNDDY (SEQ ID NO: 1707); the VL CDR1 sequence comprises QSVSSY (SEQ ID NO: 1708); the VL CDR2 sequence comprises DAS (SEQ ID NO: 1709); and the VL CDR3 sequence comprises QQSSNWPRT (SEQ ID NO: 1710).

In some embodiments, at least one arm of the multispecific activatable antibody, e.g., a bispecific activatable antibody, includes the combination of the complementarity determining region (CDR) sequences of the heavy chain amino acid sequence of SEQ ID NO: 1514. In some embodiments, at least one arm of the multispecific activatable antibody, e.g., a bispecific activatable antibody, includes the combination of the CDR sequences of the light chain amino acid sequence of SEQ ID NO: 638. In some embodiments, at least one arm of the multispecific activatable antibody, e.g., a bispecific activatable antibody, includes a combination of the CDR sequences of the heavy chain amino acid sequence of SEQ ID NO: 1514, and the CDR sequences of the light chain amino acid sequence of SEQ ID NO: 638.

In some embodiments, at least one arm of the multispecific activatable antibody, e.g., a bispecific activatable antibody, includes a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, and a variable heavy chain complementarity determining region 3 (VH CDR3, also referred to herein as CDRH3) sequence, wherein the VH CDR1 sequence comprises GYTFTNYY (SEQ ID NO: 1711); the VH CDR2 sequence comprises INPSNGGT (SEQ ID NO: 1712); and the VH CDR3 sequence comprises RRDYRFDMGFDY (SEQ ID NO: 1713).

In some embodiments, at least one arm of the multispecific activatable antibody, e.g., a bispecific activatable antibody, includes a combination of a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, at least one arm of the multispecific activatable antibody, e.g., a bispecific activatable antibody, includes a combination of a VH CDR1 sequence, a VH CDR2 sequence, a VH CDR3 sequence, a VL CDR1 sequence, a VL CDR2 sequence, and a VL CDR3 sequence, wherein the VH CDR1 sequence comprises GYTFTNYY (SEQ ID NO: 1711); the VH CDR2 sequence comprises INPSNGGT (SEQ ID NO: 1712); the VH CDR3 sequence comprises RRDYRFDMGFDY (SEQ ID NO: 1713); the VL CDR1 sequence comprises KGVSTSGYSY (SEQ ID NO: 1714); the VL CDR2 sequence comprises LAS (SEQ ID NO: 1715); and the VL CDR3 sequence comprises QHSRDLPLT (SEQ ID NO: 1716).

In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37. In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37.

In some embodiments, at least one arm of the multispecific activatable antibody, e.g., a bispecific activatable antibody, comprises a light chain amino acid that is at least 90%, 91%, 92%, 93%, 94%, 95%, 96%, 97%, 98% or 99% identical to an amino acid sequence selected from the group consisting of SEQ ID NO: 39, 41, 43, 45, 47, 49, 51, 53, 55, 57, and 59.

In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 1, 5, 9, 13, 17, 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence selected from the group consisting of SEQ ID NO: 3, 7, 11, 15, 19, 39, 41, 43, 45, 47, 49, 51, 53, 55, 57, and 59. In some embodiments, at least one arm of the multispecific activatable antibody, e.g., a bispecific activatable antibody, comprises a heavy chain amino acid sequence that is at least 90%, 91%, 92%, 93%, 94%, 95%, 96%, 97%, 98% or 99% identical to an amino acid sequence selected from the group consisting of SEQ ID NO: 21, 23, 25, 27, 29, 31, 33, 35, and 37, and a light chain amino acid that is at least 90%, 91%, 92%, 93%, 94%, 95%, 96%, 97%, 98% or 99% identical to an amino acid sequence selected from the group consisting of SEQ ID NO: 39, 41, 43, 45, 47, 49, 51, 53, 55, 57, and 59.

In some embodiments, at least one arm of the multispecific activatable antibody, e.g., a bispecific activatable antibody, includes a heavy chain amino acid sequence that is at least 90%, 91%, 92%, 93%, 94%, 95%, 96%, 97%, 98% or 99% identical to the amino acid sequence of SEQ ID NO: 1346, and a light chain amino acid that is at least 90%, 91%, 92%, 93%, 94%, 95%, 96%, 97%, 98% or 99% identical to the amino acid sequence of SEQ ID NO: 626.

In some embodiments, at least one arm of the multispecific activatable antibody, e.g., a bispecific activatable antibody, includes a heavy chain amino acid sequence that is at least 90%, 91%, 92%, 93%, 94%, 95%, 96%, 97%, 98% or 99% identical to the amino acid sequence of SEQ ID NO: 1514, and a light chain amino acid that is at least 90%, 91%, 92%, 93%, 94%, 95%, 96%, 97%, 98% or 99% identical to the amino acid sequence of SEQ ID NO: 638.

In some embodiments, at least one arm of the multispecific activatable antibody, e.g., a bispecific activatable antibody, comprises a combination of a variable heavy chain complementarity determining region 1 (VH CDR1, also referred to herein as CDRH1) sequence, a variable heavy chain complementarity determining region 2 (VH CDR2, also referred to herein as CDRH2) sequence, a variable heavy chain complementarity determining region 3 (VH CDR3, also referred to herein as CDRH3) sequence, a variable light chain complementarity determining region 1 (VL CDR1, also referred to herein as CDRL1) sequence, a variable light chain complementarity determining region 2 (VL CDR2, also referred to herein as CDRL2) sequence, and a variable light chain complementarity determining region 3 (VL CDR3, also referred to herein as CDRL3) sequence, wherein at least one CDR sequence is selected from the group consisting of a VH CDR1 sequence shown in Table 8; a VH CDR2 sequence shown in Table 8; a VH CDR3 sequence shown in Table 8; a VL CDR1 sequence shown in Table 8; a VL CDR2 sequence shown in Table 8; and a VL CDR3 sequence shown in Table 8.

In some embodiments, at least one arm of the multispecific activatable antibody, e.g., a bispecific activatable antibody, comprises a combination of a VH CDR1 sequence, a VH CDR2 sequence, a VH CDR3 sequence, a VL CDR1 sequence, a VL CDR2 sequence, and a VL CDR3 sequence, wherein at least one CDR sequence is selected from the group consisting of a VH CDR1 sequence that includes a sequence that is at least 90%, 91%, 92%, 93%, 94%, 95%, 96%, 97%, 98%, 99% or more identical to a VH CDR1 sequence shown in Table 8; a VH CD2 sequence that includes a sequence that is at least 90%, 91%, 92%, 93%, 94%, 95%, 96%, 97%, 98%, 99% or more identical to a VH CDR2 sequence shown in Table 8; a VH CDR3 sequence that includes a sequence that is at least 90%, 91%, 92%, 93%, 94%, 95%, 96%, 97%, 98%, 99% or more identical to a VH CDR3 sequence shown in Table 8; a VL CDR1 sequence that includes a sequence that is at least 90%, 91%, 92%, 93%, 94%, 95%, 96%, 97%, 98%, 99% or more identical to a VL CDR1 sequence shown in Table 8; a VL CDR2 sequence that includes a sequence that is at least 90%, 91%, 92%, 93%, 94%, 95%, 96%, 97%, 98%, 99% or more identical to a VL CDR2 sequence shown in Table 8; and a VL CDR3 sequence that includes a sequence that is at least 90%, 91%, 92%, 93%, 94%, 95%, 96%, 97%, 98%, 99% or more identical to a VL CDR3 sequence shown in Table 8.

In some embodiments, at least one arm of the multispecific activatable antibody, e.g., a bispecific activatable antibody, comprises a combination of a VH CDR1 sequence, a VH CDR2 sequence, a VH CDR3 sequence shown in a single row in Table 8, and a VL CDR1 sequence, a VL CDR2 sequence, and a VL CDR3 sequence shown in a single row in Table 8.

In some embodiments, the antibody comprises a heavy chain that comprises a combination of a VH CDR1 sequence, a VH CDR2 sequence, and a VH CDR3 sequence, wherein the combination is a combination of the three heavy chain CDR sequences (VH CDR1, VH CDR2, VH CDR3) shown in a single row in Table 8.

In some embodiments, at least one arm of the multispecific activatable antibody, e.g., a bispecific activatable antibody, comprises a combination of a VH CDR1 sequence, a VH CDR2 sequence, a VH CDR3 sequence shown in a single row in Table 8, and a VL CDR1 sequence, a VL CDR2 sequence, and a VL CDR3 sequence shown in a single row in Table 8, wherein each CDR sequence in the combination comprises a sequence that is at least 90%, 91%, 92%, 93%, 94%, 95%, 96%, 97%, 98%, 99% or more identical to the corresponding VH CDR sequence shown in a single row in Table 8 and the corresponding VL CDR sequence shown in a single row in Table 8.

In some embodiments, the antibody comprises a heavy chain that comprises a combination of a VH CDR1 sequence, a VH CDR2 sequence, and a VH CDR3 sequence, wherein each CDR sequence in the combination comprises a sequence that is at least 90%, 91%, 92%, 93%, 94%, 95%, 96%, 97%, 98%, 99% or more identical to the corresponding CDR sequence in a combination of three heavy chain CDR sequences (VH CDR1, VH CDR2, VH CDR3) shown in a single row in Table 8.

In some embodiments, the anti-PD-1 antibodies and/or activatable anti-PD-1 antibodies described herein are used in conjunction with one or more additional agents or a combination of additional agents. Suitable additional agents include other experimental anti-cancer agents in development for specific applications, current pharmaceutical and/or surgical therapies for an intended application, such as, for example, cancer. For example, the anti-PD-1 antibodies and/or activatable anti-PD-1 antibodies can be used in conjunction with an additional chemotherapeutic or antineoplastic agent.

In some embodiments, the additional agent includes at least one experimental anti-cancer agent in development for specific applications. In some embodiments, the additional agent includes at least one agent that is already approved for one indication but is being tested in another. In some embodiments, the additional agent includes at least one agent that is not currently approved in any indication but is being tested in one or more indications for the purposes of obtaining regulatory approval. In some embodiments, the additional agent includes at least one agent that is a pharmaceutical therapy for an intended application. In some embodiments, the additional agent includes at least one agent that is a surgical therapy for cancer. In some embodiments, the additional agent includes at least one agent that is a pharmaceutical therapy for an intended application. In some embodiments, the additional agent includes at least one agent that is a surgical therapy for cancer. In some embodiments, the additional agent is a chemotherapeutic agent. In some embodiments, the additional agent is an anti-neoplastic agent. In some embodiments, the additional agents are a combination of any two or more of these agents.

In some embodiments, the additional agent(s) is a chemotherapeutic agent, such as a chemotherapeutic agent selected from the group consisting of docetaxel, paclitaxel, abraxane (i.e., albumin-conjugated paclitaxel), doxorubicin, oxaliplatin, carboplatin, cisplatin, irinotecan, and gemcitabine.

In some embodiments, the additional agent(s) is a checkpoint inhibitor, a kinase inhibitor, an agent targeting inhibitors in the tumor microenvironment, and/or a T cell or NK agonist. In some embodiments, the additional agent(s) is radiation therapy, alone or in combination with another additional agent(s) such as a chemotherapeutic or anti-neoplastic agent. In some embodiments, the additional agent(s) is a vaccine, an oncovirus, and/or a DC-activating agent such as, by way of non-limiting example, a toll-like receptor (TLR) agonist and/or α-CD40. In some embodiments, the additional agent(s) is a tumor-targeted antibody designed to kill the tumor via ADCC or via direct conjugation to a toxin (e.g., an antibody drug conjugate (ADC).

In some embodiments, the checkpoint inhibitor is an inhibitor of a target selected from the group consisting of CTLA-4, LAG-3, PD-1, PD-1, TIGIT, TIM-3, B7H4, BTLA, and Vista. In some embodiments, the kinase inhibitor is selected from the group consisting of B-RAFi, MEKi, and Btk inhibitors, such as ibrutinib. In some embodiments, the kinase inhibitor is crizotinib. In some embodiments, the B-RAF inhibitor is vemurafenib. In some embodiments, the tumor microenvironment inhibitor is selected from the group consisting of an IDO inhibitor, an α-CSF1R inhibitor, an α-CCR4 inhibitor, a TGF-beta, a myeloid-derived suppressor cell, or a T-regulatory cell. In some embodiments, the agonist is selected from the group consisting of Ox40, GITR, CD137, ICOS, CD27, and HVEM.

In some embodiments, the inhibitor is a CTLA-4 inhibitor. In some embodiments, the inhibitor is a LAG-3 inhibitor. In some embodiments, the inhibitor is a PD-1 inhibitor. In some embodiments, the inhibitor is a PD-1 inhibitor. In some embodiments, the inhibitor is a TIGIT inhibitor. In some embodiments, the inhibitor is a TIM-3 inhibitor. In some embodiments, the inhibitor is a B7H4 inhibitor. In some embodiments, the inhibitor is a Vista inhibitor. In some embodiments, the inhibitor is a B-RAFi inhibitor. In some embodiments, the inhibitor is a MEKi inhibitor. In some embodiments, the inhibitor is a Btk inhibitor. In some embodiments, the inhibitor is ibrutinib. In some embodiments, the inhibitor is crizotinib. In some embodiments, the inhibitor is an IDO inhibitor. In some embodiments, the inhibitor is an α-CSF1R inhibitor. In some embodiments, the inhibitor is an α-CCR4 inhibitor. In some embodiments, the inhibitor is a TGF-beta. In some embodiments, the inhibitor is a myeloid-derived suppressor cell. In some embodiments, the inhibitor is a T-regulatory cell.

In some embodiments, the agonist is Ox40. In some embodiments, the agonist is GITR. In some embodiments, the agonist is CD137. In some embodiments, the agonist is ICOS. In some embodiments, the agonist is CD27. In some embodiments, the agonist is HVEM.

In some embodiments, the anti-PD-1 antibody and/or activatable antibody is administered during and/or after treatment in combination with one or more additional agents such as, for example, a chemotherapeutic agent, an anti-inflammatory agent, and/or an immunosuppressive agent. In some embodiments, the anti-PD-1 antibody and/or activatable anti-PD-1 antibody and the additional agent are formulated into a single therapeutic composition, and the anti-PD-1 antibody and/or activatable anti-PD-1 antibody and additional agent are administered simultaneously. Alternatively, the anti-PD-1 antibody and/or activatable anti-PD-1 antibody and additional agent are separate from each other, e.g., each is formulated into a separate therapeutic composition, and the anti-PD-1 antibody and/or activatable anti-PD-1 antibody and the additional agent are administered simultaneously, or the anti-PD-1 antibody and/or activatable anti-PD-1 antibody and the additional agent are administered at different times during a treatment regimen. For example, the anti-PD-1 antibody and/or activatable anti-PD-1 antibody is administered prior to the administration of the additional agent, the anti-PD-1 antibody and/or activatable anti-PD-1 antibody is administered subsequent to the administration of the additional agent, or the anti-PD-1 antibody and/or activatable anti-PD-1 antibody and the additional agent are administered in an alternating fashion. As described herein, the anti-PD-1 antibody and/or activatable anti-PD-1 antibody and additional agent are administered in single doses or in multiple doses.

In some embodiments, the anti-PD-1 antibody and/or activatable anti-PD-1 antibody and the additional agent(s) are administered simultaneously. For example, the anti-PD-1 antibody and/or activatable anti-PD-1 antibody and the additional agent(s) can be formulated in a single composition or administered as two or more separate compositions. In some embodiments, the anti-PD-1 antibody and/or activatable anti-PD-1 antibody and the additional agent(s) are administered sequentially, or the anti-PD-1 antibody and/or activatable anti-PD-1 antibody and the additional agent are administered at different times during a treatment regimen.

In some embodiments, the anti-PD-1 antibody and/or activatable anti-PD-1 antibody is administered during and/or after treatment in combination with one or more additional agents such as, by way of non-limiting example, a chemotherapeutic agent, an anti-inflammatory agent, and/or an immunosuppressive agent, such as an alkylating agent, an anti-metabolite, an anti-microtubule agent, a topoisomerase inhibitor, a cytotoxic antibiotic, and/or any other nucleic acid damaging agent. In some embodiments, the additional agent is a taxane, such as paclitaxel (e.g., Abraxane®). In some embodiments, the additional agent is an anti-metabolite, such as gemcitabine. In some embodiments, the additional agent is an alkylating agent, such as platinum-based chemotherapy, such as carboplatin or cisplatin. In some embodiments, the additional agent is a targeted agent, such as a kinase inhibitor, e.g., sorafenib or erlotinib. In some embodiments, the additional agent is a targeted agent, such as another antibody, e.g., a monoclonal antibody (e.g., bevacizumab), a bispecific antibody, or a multispecific antibody. In some embodiments, the additional agent is a proteosome inhibitor, such as bortezomib or carfilzomib. In some embodiments, the additional agent is an immune modulating agent, such as lenolidominde or IL-2. In some embodiments, the additional agent is radiation. In some embodiments, the additional agent is an agent considered standard of care by those skilled in the art. In some embodiments, the additional agent is a chemotherapeutic agent well known to those skilled in the art.

In some embodiments, the additional agent is another antibody or antigen-binding fragment thereof and/or another activatable antibody or antigen-binding fragment thereof. In some embodiments the additional agent is another antibody or antigen-binding fragment thereof and/or another activatable antibody or antigen-binding fragment thereof against the same target as the first antibody or antigen-binding fragment thereof and/or an activatable antibody or antigen-binding fragment thereof, e.g., against PD-1. In some embodiments the additional agent is another antibody or antigen-binding fragment thereof and/or another activatable antibody or antigen-binding fragment thereof against a target different than the target of the first antibody or antigen-binding fragment thereof, the first conjugated antibody or antigen-binding fragment thereof and/or activatable antibody or antigen-binding fragment thereof.

As a non-limiting example, the antibody or antigen-binding fragment and/or the AB of an activatable antibody is a binding partner for any target listed in Table 1.

TABLE 1

| Exemplary Targets | | | | | |
|---|---|---|---|---|---|
| 1-92-LFA-3 | CD52 | DL44 | HVEM | LIF-R | STEAP1 |
| Alpha-4 integrin | CD56 | DLK1 | Hyaluronidase | Lewis X | STEAP2 |
| Alpha-V integrin | CD64 | DLL4 | ICOS | LIGHT | TAG-72 |
| alpha4beta1 integrin | CD70 | DPP-4 | IFNalpha | LRP4 | TAPA1 |
| alpha4beta7 integrin | CD71 | DSG1 | IFNbeta | LRRC26 | TGFbeta |
| AGR2 | CD74 | EGFR | IFNgamma | MCSP | TIGIT |
| Anti-Lewis-Y | | EGFRviii | IgE | Mesothelin | TIM-3 |
| Apelin J receptor | CD80 | Endothelin B receptor (ETBR) | IgE Receptor (FceRI) | MRP4 | TLR2 |
| APRIL | CD81 | ENPP3 | IGF | MUC1 | TLR4 |
| B7-H4 | CD86 | EpCAM | IGF1R | Mucin-16 (MUC16, CA-125) | TLR6 |
| BAFF | CD95 | EPHA2 | IL1B | Na/K ATPase | TLR7 |
| BTLA | CD117 | EPHB2 | IL1R | Neutrophil elastase | TLR8 |
| C5 complement | CD125 | ERBB3 | IL2 | NGF | TLR9 |
| C-242 | CD132 (IL-2RG) | F protein of RSV | IL11 | Nicastrin | TMEM31 |
| CA9 | CD133 | FAP | IL12 | Notch Receptors | TNFalpha |
| CA19-9 (Lewis a) | CD137 | FGF-2 | IL12p40 | Notch 1 | TNFR |
| Carbonic anhydrase 9 | CD138 | FGF8 | IL-12R, IL-12Rbeta1 | Notch 2 | TNFRS12A |
| CD2 | CD166 | FGFR1 | IL13 | Notch 3 | TRAIL-R1 |
| CD3 | CD172A | FGFR2 | IL13R | Notch 4 | TRAIL-R2 |
| CD6 | CD248 | FGFR3 | IL15 | NOV | Transferrin |
| CD9 | CDH6 | FGFR4 | IL17 | OSM-R | Transferrin receptor |
| CD11a | CEACAM5 (CEA) | Folate receptor | IL18 | OX-40 | TRK-A |
| CD19 | CEACAM6 (NCA-90) | GAL3ST1 | IL21 | PAR2 | TRK-B |
| CD20 | CLAUDIN-3 | G-CSF | IL23 | PDGF-AA | uPAR |
| CD22 | CLAUDIN-4 | G-CSFR | IL23R | PDGF-BB | VAP1 |
| CD24 | cMet | GD2 | IL27/IL27R (wsx1) | PDGFRalpha | VCAM-1 |
| CD25 | Collagen | GITR | IL29 | PDGFRbeta | VEGF |
| CD27 | Cripto | GLUT1 | IL-31R | PD-1 | VEGF-A |
| CD28 | CSFR | GLUT4 | IL31/IL31R | PD-L1 | VEGF-B |
| CD30 | CSFR-1 | GM-CSF | IL2R | PD-L2 | VEGF-C |
| CD33 | CTLA-4 | GM-CSFR | IL4 | Phosphatidylserine | VEGF-D |
| CD38 | CTGF | GP IIb/IIIa receptors | IL4R | P1GF | VEGFR1 |
| CD40 | CXCL10 | Gp130 | IL6, IL6R | PSCA | VEGFR2 |
| CD40L | CXCL13 | GPIIB/IIIA | Insulin Receptor | PSMA | VEGFR3 |
| CD41 | CXCR1 | GPNMB | Jagged Ligands | RAAG12 | VISTA |
| CD44 | CXCR2 | GRP78 | Jagged 1 | RAGE | WISP-1 |
| CD44v6 | | HER2/neu | Jagged 2 | sLC44A4 | WISP-2 |
| CD47 | CXCR4 | HGF | LAG-3 | Sphingosine 1 Phosphate | WISP-3 |
| CD51 | CYR61 | hGH | | | |

As a non-limiting example, the antibody or antigen-binding fragment and/or the AB of an activatable antibody is or is derived from an antibody listed in Table 2.

TABLE 2

Exemplary sources for Abs

| Antibody Trade Name (antibody name) | Target |
|---|---|
| Avastin ™ (bevacizumab) | VEGF |
| Lucentis ™ (ranibizumab) | VEGF |
| Erbitux ™ (cetuximab) | EGFR |
| Vectibix ™ (panitumumab) | EGFR |
| Remicade ™ (infliximab) | TNFα |
| Humira ™ (adalimumab) | TNFα |
| Tysabri ™ (natalizumab) | Integrinα4 |
| Simulect ™ (basiliximab) | IL2R |
| Soliris ™ (eculizumab) | Complement C5 |
| Raptiva ™ (efalizumab) | CD11a |
| Bexxar ™ (tositumomab) | CD20 |
| Zevalin ™ (ibritumomab tiuxetan) | CD20 |
| Rituxan ™ (rituximab) | CD20 |
| Ocrelizumab | CD20 |
| Arzerra ™ (ofatumumab) | CD20 |
| Gazyva ™ (Obinutuzumab) | CD20 |
| Zenapax ™ (daclizumab) | CD25 |
| Adcetris ™ (brentuximab vedotin) | CD30 |
| Myelotarg ™ (gemtuzumab) | CD33 |
| Mylotarg ™ (gemtuzumab ozogamicin) | CD33 |
| Campath ™ (alemtuzumab) | CD52 |
| ReoPro ™ (abiciximab) | Glycoprotein receptor IIb/IIIa |
| Xolair ™ (omalizumab) | IgE |
| Herceptin ™ (trastuzumab) | Her2 |
| Kadcyla ™ (trastuzumab emtansine) | Her2 |
| Synagis ™ (palivizumab) | F protein of RSV |
| (ipilimumab) | CTLA-4 |
| (tremelimumab) | CTLA-4 |
| Hu5c8 | CD40L |
| (pertuzumab) | Her2-neu |
| (ertumaxomab) | CD3/Her2-neu |
| Orencia ™ (abatacept) | CTLA-4 |
| (tanezumab) | NGF |
| (bavituximab) | Phosphatidylserine |
| (zalutumumab) | EGFR |
| (mapatumumab) | EGFR |
| (matuzumab) | EGFR |
| (nimotuzumab) | EGFR |
| ICR62 | EGFR |
| mAb 528 | EGFR |
| CH806 | EGFR |
| MDX-447 | EGFR/CD64 |
| (edrecolomab) | EpCAM |
| RAV12 | RAAG12 |
| huJ591 | PSMA |
| Enbrel ™ (etanercept) | TNF-R |
| Amevive ™ (alefacept) | 1-92-LFA-3 |
| Antril ™, Kineret ™ (ankinra) | IL-1Ra |
| GC1008 | TGFbeta |
|  | Notch, e.g., Notch 1 Jagged 1 or Jagged 2 |
| (adecatumumab) | EpCAM |
| (figitumumab) | IGF1R |
| (tocilizumab) | IL-6 receptor |
| Stelara ™ (ustekinumab) | IL-12/IL-23 |
| Prolia ™ (denosumab) | RANKL |

In some embodiments, the additional antibody or antigen binding fragment thereof and/or activatable antibody or antigen binding fragment thereof is a monoclonal antibody, domain antibody, single chain, Fab fragment, a F(ab')$_2$ fragment, a scFv, a scAb, a dAb, a single domain heavy chain antibody, or a single domain light chain antibody. In some embodiments, the additional antibody or antigen binding fragment thereof and/or activatable antibody or antigen binding fragment thereof is a mouse, other rodent, chimeric, humanized or fully human monoclonal antibody.

The disclosure also provides methods of producing an anti-PD-1 antibody and/or activatable anti-PD-1 antibody polypeptide by culturing a cell under conditions that lead to expression of the polypeptide, wherein the cell comprises an isolated nucleic acid molecule encoding an antibody and/or an activatable antibody described herein, and/or vectors that include these isolated nucleic acid sequences. The disclosure provides methods of producing an antibody and/or activatable antibody by culturing a cell under conditions that lead to expression of the antibody and/or activatable antibody, wherein the cell comprises an isolated nucleic acid molecule encoding an antibody and/or an activatable antibody described herein, and/or vectors that include these isolated nucleic acid sequences.

The invention also provides a method of manufacturing activatable antibodies that in an activated state binds PD-1 by (a) culturing a cell comprising a nucleic acid construct that encodes the activatable antibody under conditions that lead to expression of the activatable antibody, wherein the activatable antibody comprises a masking moiety (MM), a cleavable moiety (CM), and an antibody or an antigen binding fragment thereof (AB) that specifically binds PD-1, (i) wherein the CM is a polypeptide that functions as a substrate for a protease; and (ii) wherein the CM is positioned in the activatable antibody such that, when the activatable antibody is in an uncleaved state, the MM interferes with specific binding of the AB to PD-1 and in a cleaved state the MM does not interfere or compete with specific binding of the AB to PD-1; and (b) recovering the activatable antibody. Suitable AB, MM, and/or CM include any of the AB, MM, and/or CM disclosed herein.

In some embodiments, the activatable antibody in the uncleaved state has the structural arrangement from N-terminus to C-terminus as follows: MM-CM-AB or AB-CM-MM. In some embodiments, the activatable antibody comprises a linking peptide between the MM and the CM. In some embodiments, the activatable antibody comprises a linking peptide between the CM and the AB. In some embodiments, the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM. In some embodiments, the activatable antibody in the uncleaved state has the structural arrangement from N-terminus to C-terminus as follows: spacer-MM-LP1-CM-LP2-AB or AB-LP2-CM-LP1-MM-spacer.

In some embodiments, the two linking peptides need not be identical to each other.

In some embodiments, at least one of LP1 or LP2 comprises an amino acid sequence selected from the group consisting of (GS)$_n$, (GGS)$_n$, (GSGGS)$_n$ (SEQ ID NO: 363) and (GGGS)$_n$ (SEQ ID NO: 364), where n is an integer of at least one.

In some embodiments, at least one of LP1 or LP2 comprises an amino acid sequence selected from the group consisting of GGSG (SEQ ID NO: 365), GGSGG (SEQ ID NO: 366), GSGSG (SEQ ID NO: 367), GSGGG (SEQ ID NO: 368), GGGSG (SEQ ID NO: 369), and GSSSG (SEQ ID NO: 370).

In some embodiments, LP1 comprises the amino acid sequence GSSGGSGGSGGSG (SEQ ID NO: 371), GSSGGSGGSGG (SEQ ID NO: 372), GSSGGSGGSGGS (SEQ ID NO: 373), GSSGGSGGSGGSGGGS (SEQ ID NO: 374), GSSGGSGGSG (SEQ ID NO: 375), GSSGGSGGSGS (SEQ ID NO: 376), GGGSSGGS (SEQ ID NO: 65), or GGGSSGG (SEQ ID NO: 1040).

In some embodiments, LP2 comprises the amino acid sequence GSS, GGS, GGGS (SEQ ID NO: 377), GSSGT (SEQ ID NO: 378) or GSSG (SEQ ID NO: 379).

The invention provides methods of preventing, delaying the progression of, treating, alleviating a symptom of, or otherwise ameliorating a disorder or disease in a subject by administering to a subject in need thereof a therapeutically effective amount of an anti-PD-1 antibody, conjugated anti-PD-1 antibody, activatable anti-PD-1 antibody and/or conjugated activatable anti-PD-1 antibody described herein.

The invention also provides a method of reducing immune suppression comprising administering to a subject in need thereof a therapeutically effective amount of an anti-PD-1 antibody and/or activatable anti-PD-1 antibody described herein. In some embodiments, the immune suppression is suppression of T cell activity. In some embodiments, the immune suppression is mediated by engagement of PD-1 on T cells to PD-L1 or PD-L2 on tumor cells or other immune cells. In some embodiments, the invention provides a method to reduce or inhibit binding of PD-L1 (also referred to herein as PDL1) and/or PD-L2 (also referred to herein as PDL2), to PD-1 on T cells. The ligands PD-L1 and/or PD-L2 are often found on tumor cells or other immune cells.

The invention also provides methods of preventing, delaying the progression of, treating, alleviating a symptom of, or otherwise ameliorating cancer in a subject by administering a therapeutically effective amount of an anti-PD-1 antibody and/or activatable anti-PD-1 antibody described herein to a subject in need thereof. PD-1 is known to be expressed on immune cells, such as T cells, in a variety of cancers, such as, by way of non-limiting example, melanoma, non-small cell lung cancer, nasopharyngeal cancer, glioblastoma/mixed glioma, colon adenocarcinoma, hepatocellular carcinoma, urothelial cancer, multiple myeloma, ovarian cancer, gastric carcinoma, esophageal cancer, pancreatic cancer, renal cell carcinoma (RCC), breast cancer, lymphomas, such as Hodgkin's lymphoma, and leukemias. (See e.g., Chen et al., "Molecular Pathways: Next-Generation Immunotherapy—Inhibiting Programmed Death-Ligand 1 and Programmed Death-1," Clin. Can. Res., vol. 18: 6580-6587 (2012), the contents of which are hereby incorporated by reference in their entirety).

In some embodiments, the cancer is a bladder cancer, a bone cancer, a breast cancer, a carcinoid, a cervical cancer, a cholangiocarcinoma, a colon cancer, an endometrial cancer, a glioma, a head and neck cancer, a liver cancer, a lung cancer, a lymphoma, such as Hodgkin's lymphoma, a melanoma, an ovarian cancer, a pancreatic cancer, a prostate cancer, a renal cancer, a sarcoma, a skin cancer, a stomach cancer, a testis cancer, a thymus cancer, a thyroid cancer, a urogenital cancer, and/or a urothelial cancer.

In some embodiments, the cancer is selected from the group consisting of melanoma (MEL), renal cell carcinoma (RCC), squamous non-small cell lung cancer (NSCLC), non-squamous NSCLC, colorectal cancer (CRC), castration-resistant prostate cancer (CRPC), hepatocellular carcinoma (HCC), squamous cell carcinoma of the head and neck, thymoma, carcinomas of the esophagus, ovary, gastrointestinal tract and breast, or a hematologic malignancy such as multiple myeloma, B-cell lymphoma, T-cell lymphoma, Hodgkin's lymphoma, primary mediastinal B-cell lymphoma, and chronic myelogenous leukemia.

The invention also provides methods of treating cancer patients with an autoimmune or inflammatory disease by administering a therapeutically effective amount of an anti-PD-1 antibody and/or activatable anti-PD-1 antibody described herein to a subject in need thereof. In some embodiments, the autoimmune disease is colitis, RA, pancreatitis, diabetes, or pneumonitis.

An anti-PD-1 antibody and/or an activatable anti-PD-1 antibody used in any of the embodiments of these methods and uses can be administered at any stage of the disease. For example, such an anti-PD-1 antibody and/or activatable anti-PD-1 antibody can be administered to a patient suffering cancer of any stage, from early to metastatic. The terms subject and patient are used interchangeably herein.

In some embodiments, the subject is a mammal, such as a human, non-human primate, companion animal (e.g., cat, dog, horse), farm animal, work animal, or zoo animal. In some embodiments, the subject is a human. In some embodiments, the subject is a companion animal. In some embodiments, the subject is an animal in the care of a veterinarian.

The anti-PD-1 antibody and/or activatable anti-PD-1 antibody and therapeutic formulations thereof are administered to a subject suffering from or susceptible to a disease or disorder associated with immune suppression, such as immune suppression mediated by engagement of PD-1 on T cells by PD-L1 or PD-L2 on tumor cells or other immune cells. In some embodiments, the immune suppression is suppression of T cell activity. A subject suffering from or susceptible to a disease or disorder associated with such immune suppression is identified using any of a variety of methods known in the art. For example, subjects suffering from cancer or other neoplastic condition are identified using any of a variety of clinical and/or laboratory tests such as, physical examination and blood, urine and/or stool analysis to evaluate health status. For example, subjects suffering from inflammation and/or an inflammatory disorder are identified using any of a variety of clinical and/or laboratory tests such as physical examination and/or bodily fluid analysis, e.g., blood, urine and/or stool analysis, to evaluate health status.

Administration of an anti-PD-1 antibody and/or activatable anti-PD-1 antibody to a patient suffering from a disease or disorder associated with immune suppression, such as immune suppression mediated by engagement of PD-1 on T cells by PD-L1 or PD-L2 on tumor cells or other immune cells, is considered successful if any of a variety of laboratory or clinical objectives is achieved. For example, administration of an anti-PD-1 antibody, and/or activatable anti-PD-1 antibody to a patient suffering from a disease or disorder associated with such immune suppression is considered successful if one or more of the symptoms associated with the disease or disorder is alleviated, reduced, inhibited or does not progress to a further, i.e., worse, state. Administration of an anti-PD-1 antibody and/or conjugated activatable anti-PD-1 antibody to a patient suffering from a disease or disorder associated with immune suppression, such as immune suppression mediated by engagement of PD-1 on T cells to PD-L1 or PD-L2 on tumor cells or other immune cells, is considered successful if the disease or disorder enters remission or does not progress to a further, i.e., worse, state.

In some embodiments, the anti-PD-1 antibody and/or conjugated activatable anti-PD-1 antibody is administered during and/or after treatment in combination with one or more additional agents such as, for example, a chemotherapeutic agent, an anti-inflammatory agent, and/or an immunosuppressive agent. In some embodiments, the anti-PD-1 antibody and/or activatable anti-PD-1 antibody and the additional agent(s) are administered simultaneously. For example, the anti-PD-1 antibody and/or activatable anti-PD-1 antibody and the additional agent(s) can be formulated in a single composition or administered as two or more separate compositions. In some embodiments, the anti-PD-1 antibody and/or activatable anti-PD-1 antibody and the additional agent(s) are administered sequentially.

The invention also provides methods and kits for using the activatable anti-PD-1 antibodies in a variety of diagnostic and/or prophylactic indications. For example, the invention provides methods and kits for detecting the presence or absence of a cleaving agent and a target of interest in a subject or a sample by (i) contacting a subject or sample with an anti-PD-1 activatable antibody, wherein the anti-PD-1 activatable antibody comprises a masking moiety (MM), a cleavable moiety (CM) that is cleaved by the cleaving agent, and an antigen binding domain or fragment thereof (AB) that specifically binds the target of interest, wherein the anti-PD-1 activatable antibody in an uncleaved, non-activated state comprises a structural arrangement from N-terminus to C-terminus as follows: MM-CM-AB or AB-CM-MM; (a) wherein the MM is a peptide that inhibits binding of the AB to PD-1, and wherein the MM does not have an amino acid sequence of a naturally occurring binding partner of the AB and is not a modified form of a natural binding partner of the AB; and (b) wherein, when the AB is in an uncleaved, non-activated state, the MM interferes with specific binding of the AB to PD-1, and when the AB is in a cleaved, activated state the MM does not interfere or compete with specific binding of the AB to PD-1; and (ii) measuring a level of activated anti-PD-1 activatable antibody in the subject or sample, wherein a detectable level of activated anti-PD-1 activatable antibody in the subject or sample indicates that the cleaving agent and PD-1 are present in the subject or sample and wherein no detectable level of activated anti-PD-1 activatable antibody in the subject or sample indicates that the cleaving agent, PD-1 or both the cleaving agent and PD-1 are absent in the subject or sample.

In some embodiments, the activatable anti-PD-1 antibody is an activatable anti-PD-1 antibody to which a therapeutic agent is conjugated. In some embodiments, the activatable anti-PD-1 antibody is not conjugated to an agent. In some embodiments, the activatable anti-PD-1 antibody comprises a detectable label. In some embodiments, the detectable label is positioned on the AB. In some embodiments, measuring the level of activatable anti-PD-1 antibody in the subject or sample is accomplished using a secondary reagent that specifically binds to the activated antibody, wherein the reagent comprises a detectable label. In some embodiments, the secondary reagent is an antibody comprising a detectable label.

In some embodiments of these methods and kits, the activatable anti-PD-1 antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or β-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor®680 or Alexa Fluor® 750. In some embodiments of these methods and kits, the ligand-based label comprises biotin, avidin, streptavidin or one or more haptens.

In some embodiments of these methods and kits, the subject is a mammal. In some embodiments of these methods, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods and kits, the method is an in vivo method. In some embodiments of these methods, the method is an in situ method. In some embodiments of these methods, the method is an ex vivo method. In some embodiments of these methods, the method is an in vitro method.

In some embodiments of the methods and kits, the method is used to identify or otherwise refine a patient population suitable for treatment with an anti-PD-1 activatable antibody of the disclosure, followed by treatment by administering that activatable anti-PD-1 antibody to a subject in need thereof. For example, patients that test positive for both the target (e.g., PD-1) and a protease that cleaves the substrate in the cleavable moiety (CM) of the anti-PD-1 activatable antibody being tested in these methods are identified as suitable candidates for treatment with such an anti-PD-1 activatable antibody comprising such a CM, and the patient is then administered a therapeutically effective amount of the activatable anti-PD-1 antibody that was tested. Likewise, patients that test negative for either or both of the target (e.g., PD-1) and the protease that cleaves the substrate in the CM in the activatable antibody being tested using these methods might be identified as suitable candidates for another form of therapy. In some embodiments, such patients can be tested with other anti-PD-1 activatable antibodies until a suitable anti-PD-1 activatable antibody for treatment is identified (e.g., an anti-PD-1 activatable antibody comprising a CM that is cleaved by the patient at the site of disease). In some embodiments, the patient is then administered a therapeutically effective amount of the activatable anti-PD-1 antibody for which the patient tested positive. Suitable AB, MM, and/or CM include any of the AB, MM, and/or CM disclosed herein.

Pharmaceutical compositions according to the invention can include an antibody of the invention and a carrier. These pharmaceutical compositions can be included in kits, such as, for example, diagnostic kits.

BRIEF DESCRIPTION OF THE DRAWINGS

FIGS. 11A and 11B are a series of graphs depicting the ability of the anti-PD-1 antibody A1.5 to block Fab fragments of the anti-PD-1 antibodies nivolumab ("NV1") and pembrolizumab ("PM1") from binding to PD-1. These graphs also demonstrate that the anti-PD-1 antibody A1.5 binds a distinct epitope from either NV1 and/or PM1.

In FIG. 12, PMBCs were treated as follows: PBMCs: CMV+ HemaCare Donor C were plated at 2×10⁵ cells/well; stimulated with 5 g/mL CMV lysate+/− anti-PD-1 or isotype control; IFN-γ ELISA assay performed on day 4 supernatant.

FIG. 16 is a graph depicting the binding to hPD-1 by anti-PD-1 antibody A1.5 and various activatable anti-PD-1 antibodies that include the anti-PD-1 antibody A1.5, the cleavable moiety referred to herein as 3001, which includes the sequence AVGLLAPPGGLSGRSDNH (SEQ ID NO: 318), and the masking moieties referred to herein as PD02, PD12, and PD16.

In FIG. 19, PMBCs were treated as follows: PBMCs: CMV+ HemaCare Donor C were plated at 2×10⁵ cells/well; stimulated with 5 g/mL CMV lysate+/−anti-PD-1 or isotype control; IFN-γ ELISA assay performed on day 4 supernatant.

FIG. 31A shows the binding of the anti-human PD-1 A1.5 Ab to immobilized human PD1 as detected by standard plate ELISA, and FIG. 31B shows the binding of A1.5 Ab to cynomolgus PD1 as detected by ELISA. FIG. 32C depicts the inhibition of biotinylated human PD-L1 to immobilized PD1 by A1.5 Ab as determined by ELISA, and FIG. 32D depicts the inhibition of biotinylated human PD-L2 to immobilized PD1 as determined by ELISA. FIG. 32E demonstrations that the A1.5 Ab enhances IFN-γ production in a CMV T cell restimulation assay.

DETAILED DESCRIPTION OF THE INVENTION

Figure 1:
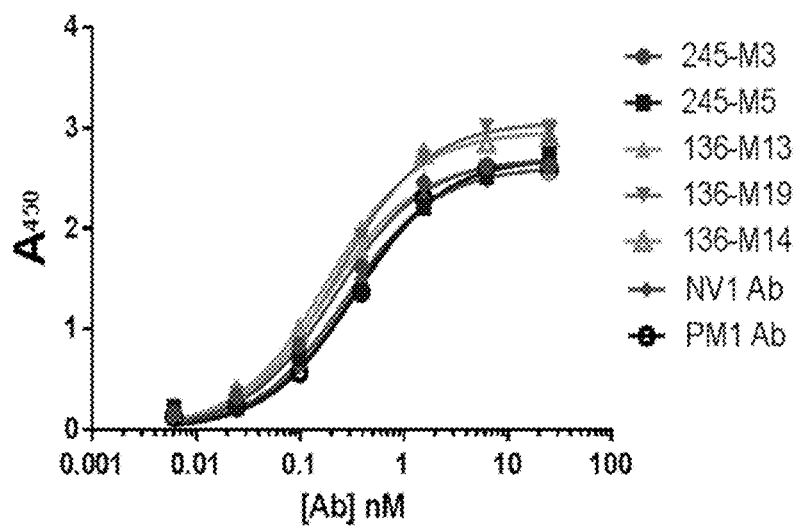
FIG. 1 is graph depicting the results of an ELISA binding assay using various murine antibodies that bind human PD-1 (i.e., anti-hPD-1 antibodies) referred to herein as 245-M3, also referred to herein as M3 (VH: SEQ ID NO: 9; VL: SEQ ID NO: 11), 245-M5, also referred to herein as M5 (VH: SEQ ID NO: 13; VL: SEQ ID NO: 15), 136-M13, also referred to herein as M13 (VH: SEQ ID NO: 1; VL: SEQ ID NO: 3), 136-M19, also referred to herein as M19 (VH: SEQ ID NO: 5; VL: SEQ ID NO: 7), and 136-M14, also referred to herein as M14 (VH: SEQ ID NO: 17; VL: SEQ ID NO: 19). The anti-PD-1 antibodies nivolumab (also referred to herein as "nivo" or "NV1") and pembrolizumab (also referred to herein as "pembro" or "PM1" or "PM1 AB") were used as positive controls.

The present invention provides monoclonal antibodies (mAbs), activatable antibodies, and antigen-binding fragments thereof that specifically bind programmed cell death protein 1 (PD-1), also known as CD279. The use of the term "PD-1" is intended to cover any variation thereof, such as, by way of non-limiting example, PD1 and/or PD 1, all variations are used herein interchangeably. Aberrant expression and/or activity of PD-1 and PD-1-related signaling has been implicated in the pathogenesis of many diseases and disorders, such as cancer.

PD-1, a cell surface receptor that belongs to the immunoglobulin superfamily, is expressed on T cells and pro-B cells. PD-1 is known to bind two ligands, PD-L1 and PD-L2. PD-1 is expressed on the surface of activated T cells, and the interaction between PD-1 and PD-L1 and/or PD-L2 functions as an immune checkpoint, as the binding of PD-L1 or PD-L2 to PD-1 inactivates the T cell. Thus, PD-1 plays a role in down-regulating the immune system by preventing the activation of T-cells, which, in turn, reduces autoimmunity and promotes self-tolerance.

The anti-PD-1 monoclonal antibodies and activated activatable anti-PD-1 antibodies of the disclosure bind and neutralize or otherwise inhibit the ability of PD-1 to bind or otherwise interact with PD-L1 and/or PD-L2. The anti-PD-1 monoclonal antibodies and activated activatable anti-PD-1 antibodies of the disclosure bind and neutralize or otherwise inhibit at least one biological activity of PD-1. For example, the anti-PD-1 monoclonal antibodies and activated activatable anti-PD-1 antibodies of the disclosure bind PD-1 and block or otherwise inhibit ligand activation of PD-1 on activated T cells. In contrast to traditional chemotherapies and other targeted anti-cancer therapies, which exert their effects by direct cytotoxic or tumor growth inhibition, the monoclonal antibodies and activatable antibodies of the disclosure block a negative regulator of T-cell activation and response, thereby allowing the immune system to attack the tumor.

The activatable anti-PD-1 antibodies of the disclosure include an antibody or antigen-binding fragment thereof that specifically binds PD-1 coupled to a masking moiety (MM), such that coupling of the MM reduces the ability of the antibody or antigen-binding fragment thereof to bind PD-1. The MM is coupled via a cleavable moiety (CM) that includes a sequence that functions as a substrate for a protease.

The activatable anti-PD-1 antibodies of the disclosure are activated when the cleavable moiety is cleaved by a protease. For example, the protease is produced by a tumor that is in proximity to T cells that express PD-1. In some embodiments, the protease is produced by a tumor that is co-localized with T cells that express PD-1. In the activated, i.e., cleaved state, the activatable anti-PD-1 antibodies of the disclosure bind PD-1 expressed on a T cell surface.

The activatable anti-PD-1 antibodies are used in methods of treating, preventing, delaying the progression of, ameliorating and/or alleviating a symptom of a disease or disorder associated with binding of a ligand selected from the group consisting of PD-L1 and PD-L2 to PD-1 on a T cell. Such ligands are often found on tumor cells and other immune cells. Binding of such ligands to PD-1 can lead to immune suppression, such as suppression of T cell activity, which is reduced by anti-PD1 antibodies and activatable anti-PD-1 antibodies of the disclosure. For example, the activatable anti-PD-1 antibodies are used in methods of treating, preventing, delaying the progression of, ameliorating and/or alleviating a symptom of a cancer or other neoplastic condition.

Exemplary activatable anti-PD-1 antibodies of the invention include, for example, activatable antibodies that include a heavy chain and a light chain that are, or are derived from, antibodies described in the Examples, for example in Examples 1, 2, 8, 9, 14, and 15.

In some embodiments, the activatable anti-PD-1 antibody includes a heavy chain that comprises or is derived from an amino acid sequence selected from the group consisting of SEQ ID NO: 1, 5, 9, 13, 17, 21, 23, 25, 27, 29, 31, 33, 35, and 37, and a light chain that comprises or is derived from an amino acid sequence selected from the group consisting of SEQ ID NO: 3, 7, 11, 15, 19, 39, 41, 43, 45, 47, 49, 51, 53, 55, 57, 59, 215, 217, 219, 221, 223, 225, 227, 229, 231, 233, 235, 237, 239, 241, 245, 247, 249, 251, 253, 255, 257, 259, 261, 263, 265, 267, 269, 271, 273, 275, 277, 279, 281, 283, 285, 287, 289, 291, 293, 515, 517, 519, 521, 523, 525, 527, 529, 531, 533, 535, 537, 539, 541, 572, 574, 576, 578, 580, 582, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1030, 1032, 1034, 1036, 1039, 1041-1090, 1113-1120, 1123, 1124, 1127, 1128, 1131, 1132, 1134, 1135, 1138, 1139, 1143, 1144, 1147, 1148, 1151, 1152, 1155, 1156, 1159, 1160, 1163, 1164, 1167, 1168, 1170, 1171, 1174, 1175, 1178, 1179, 1182, 1183, 1186, 1187, 1190, 1191, 1194, 1195, 1198, 1199, 1202, 1203, 2055, 2054, 2057, 2056, 2059, and 2058.

In some embodiments, the activatable anti-PD-1 antibody includes a heavy chain that comprises or is derived from an amino acid sequence selected from the group consisting of SEQ ID NO: 21, 23, 25, 27, 29, 31, 33, 35, and 37, and a light chain that comprises or is derived from an amino acid sequence selected from the group consisting of SEQ ID NO: 39, 41, 43, 45, 47, 49, 51, 53, 55, 57, 59, 215, 217, 219, 221, 223, 225, 227, 229, 231, 233, 235, 237, 239, 241, 245, 247, 249, 251, 253, 255, 257, 259, 261, 263, 265, 267, 269, 271, 273, 275, 277, 279, 281, 283, 285, 287, 289, 291, 293, 515, 517, 519, 521, 523, 525, 527, 529, 531, 533, 535, 537, 539, 541, 572, 574, 576, 578, 580, 582, 584, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1030, 1032, 1034, 1036, 1039, 1041-1090, 1113-1120, 1123, 1127, 1131, 1134, 1138, 1144, 1148, 1152, 1156, 1160, 1164, 1168, 1170, 1174, 1178, 1182, 1186, 1190, 1194, 1198, 1203, 2055, 2054, 2057, 2056, 2059, and 2058.

In some embodiments, the light chain comprises or is derived from an amino acid sequence selected from the group consisting of SEQ ID NO: 39, 41, 43, 45, 47, 49, 51, 53, 55, 57, and 59. In some embodiments, the light chain comprises or is derived from an amino acid sequence selected from the group consisting of SEQ ID NO: 215, 217, 219, 221, 223, 225, 227, 229, 231, 233, 235, 237, 239, 241, 245, 247, 249, 251, 253, 255, 257, 259, 261, 263, 265, 267, 269, 271, 273, 275, 277, 279, 281, 283, 285, 287, 289, 291, 293, 584, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, and 997.

In some embodiments, the activatable anti-PD-1 antibody includes a heavy chain that comprises or is derived from an amino acid sequence selected from the group consisting of SEQ ID NO: 21, 23, 25, 27, 29, 31, 33, 35, and 37, and a light chain that comprises or is derived from an amino acid sequence selected from the group consisting of 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 572, 574, 576, 578, 580, 582, 1029, 1120, 1124, 1128, 1132, 1135, 1139, 1143, 1147, 1151, 1155, 1159, 1163, 1167, 1171, 1175, 1179, 1183, 1187, 1191, 1195, 1199, 1203, 2055, 2054, 2057, 2056, 2059, and 2058.

In some embodiments, the light chain comprises or is derived from an amino acid sequence selected from the group consisting of SEQ ID NO: 515, 517, 519, 521, 523, 525, 527, 529, 531, 533, 535, 537, 539, 541, 572, 574, 576, 578, 580, 582, 999, 1001, 1003, 1005, 1007, 1009, 1011, 1013, 1015, 1017, 1019, 1021, 1023, 1025, 1027, 1029, 1030, 1032, 1034, 1036, 1039, 1041-1090, 1113-1120, 1123, 1127, 1131, 1134, 1138, 1144, 1148, 1152, 1156, 1160, 1164, 1168, 1170, 1174, 1178, 1182, 1186, 1190, 1194, 1198, 1203, 2055, 2054, 2057, 2056, 2059, and 2058.

In some embodiments, the activatable anti-PD-1 antibody includes a light chain that comprises or is derived from an amino acid sequence selected from the group consisting of SEQ ID NOs: 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 515, 517, 519, 521, 523, 525, 527, 529, 531, 533, 535, 537, 539, 541, 572, 574, 576, 578, 580, 582, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 1027, 1028, 1029, 1030, 1032, 1034, 1036, 1039, 1041-1076, 1113-1120, 1123, 1124, 1127, 1128, 1131, 1132, 1134, 1135, 1138, 1139, 1143, 1144, 1147, 1148, 1151, 1152, 1155, 1156, 1159, 1160, 1163, 1164, 1167, 1168, 1170, 1171, 1174, 1175, 1178, 1179, 1182, 1183, 1186, 1187, 1190, 1191, 1194, 1195, 1198, 1199, 1202, 12032055, 2054, 2057, 2056, 2059, and 2058.

In some embodiments, the activatable anti-PD-1 antibody includes a heavy chain that comprises or is derived from an amino acid sequence selected from the group consisting of SEQ ID NO: 21, 23, 25, 27, 29, 31, 33, 35, and 37, and a light chain that comprises or is derived from an amino acid sequence selected from the group consisting of SEQ ID NOs: 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 1028, 1029, 1041-1076, 1138, 1139, 1143, 1144, 1147, 1148, 1151, 1152, 1155, 1156, 1159, 1160, 1163, 1164, 1167, 1168, 1170, 1171, 1174, 1175, 1178, 1179, 1182, 1183, 1186, 1187, 1190, 1191, 1194, 1195, 1198, 1199, 1202, 1203, 2055, 2054, 2057, 2056, 2059, and 2058.

In some embodiments, the light chain comprises or is derived from an amino acid sequence selected from the group consisting of SEQ ID NOs: 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 1028, 1041-1076, 1138, 1144, 1148, 1152, 1156, 1160, 1164, 1168, 1170, 1174, 1178, 1182, 1186, 1190, 1194, 1198, 1202, 2055, 2057, and 2059.

In some embodiments, the light chain comprises or is derived from an amino acid sequence selected from the group consisting of SEQ ID NOs: 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 1029, 1139, 1143, 1147, 1151, 1155, 1159, 1163, 1167, 1171, 1175, 1179, 1183, 1187, 1191, 1195, 1199, 1203, 2054, 2056, and 2058.

In some embodiments, the activatable anti-PD-1 antibody includes a heavy chain that comprises or is derived from an amino acid sequence selected from the group consisting of SEQ ID NO: 546 and a light chain that comprises or is derived from an amino acid sequence selected from the group consisting of SEQ ID NOs: 515, 517, 519, 521, 523, 525, 527, 529, 531, 533, 535, 537, 539, 541, 572, 574, 576, 578, 580, 582, 999, 1001, 1003, 1005, 1007, 1009, 1011, 1013, 1015, 1017, 1019, 1021, 1023, 1025, 1027, 1030, 1032, 1034, 1036, 1039, 1077-1090, 1113-1120, 1123, 1124, 1127, 1128, 1131, 1132, 1134, and 1135.

In some embodiments, the activatable anti-PD-1 antibody includes a light chain that comprises or is derived from an amino acid sequence selected from the group consisting of SEQ ID NOS: 999, 1001, 1003, 1005, 1007, 1009, 1011, 1013, 1015, 1017, 1019, 1021, 1023, 1025, 1027, 1030, 1032, 1034, 1036, 1039, 1070-1090, 1119, 1123, 1127, 1131, and 1134.

In some embodiments, the activatable anti-PD-1 antibody includes a light chain that comprises or is derived from an amino acid sequence selected from the group consisting of SEQ ID NOS: 515, 517, 519, 521, 523, 525, 527, 529, 531, 533, 535, 537, 539, 541, 572, 574, 576, 578, 580, 582, 1120, 1124, 1128, 1132, and 1135.

In some embodiments, the activatable anti-PD-1 antibody includes a heavy chain that comprises or is derived from a heavy chain amino acid sequence shown in Table 7. In some embodiments, the activatable anti-PD-1 antibody includes a light chain that comprises or is derived from a light chain amino acid sequence shown in Table 7. In some embodiments, the activatable anti-PD-1 antibody includes a heavy chain that comprises or is derived from a heavy chain amino acid sequence shown in Table 7, and a light chain that comprises or is derived from a light chain amino acid sequence shown in Table 7. In some embodiments, the activatable anti-PD-1 antibody includes a combination of a heavy chain variable region sequence and a light chain variable region sequence from the combinations shown in Group A in Table 7. In some embodiments, the activatable anti-PD-1 antibody includes a combination of a heavy chain variable region sequence and a light chain variable region sequence from the combinations shown in Group B in Table 7. In some embodiments, the activatable anti-PD-1 antibody includes a combination of a heavy chain variable region sequence and a light chain variable region sequence from the combinations shown in Group C in Table 7. In some embodiments, the activatable anti-PD-1 antibody includes a combination of a heavy chain variable region sequence and a light chain variable region sequence from the combinations shown in Group D in Table 7. In some embodiments, the activatable anti-PD-1 antibody includes a combination of a heavy chain variable region sequence and a light chain variable region sequence from the combinations shown in Group E in Table 7. In some embodiments, the activatable anti-PD-1 antibody includes a combination of a heavy chain variable region sequence and a light chain variable region sequence from the combinations shown in Group F in Table 7. In some embodiments, the activatable anti-PD-1 antibody includes a combination of a heavy chain variable region sequence and a light chain variable region sequence from the combinations shown in Group H in Table 7. In some embodiments, the activatable anti-PD-1 antibody includes a combination of a heavy chain variable region sequence and a light chain variable region sequence from the combinations shown in Group I in Table 7. In some embodiments, the activatable anti-PD-1 antibody includes a combination of a heavy chain variable region sequence and a light chain variable region sequence from the combinations shown in Group J in Table 7. In some embodiments, the activatable anti-PD-1 antibody includes a combination of a heavy chain variable region sequence and a light chain variable region sequence from the combinations shown in Group K in Table 7. In some embodiments, the activatable anti-PD-1 antibody includes a combination of a heavy chain variable region sequence and a light chain variable region sequence from the combinations shown in Group L in Table 7. In some embodiments, the activatable anti-PD-1 antibody includes a combination of a heavy chain variable region sequence and a light chain variable region sequence from the combinations shown in Group M in Table 7. In some embodiments, the activatable anti-PD-1 antibody includes a combination of the heavy chain variable region sequence and the light chain variable region sequence as shown in Group N in Table 7. In some embodiments, the activatable anti-PD-1 antibody includes a combination of the heavy chain variable region sequence and the light chain variable region sequence as shown in Group O in Table 7. In some embodiments, the activatable anti-PD-1 antibody includes a combination of a heavy chain variable region sequence and a light chain variable region sequence from the combinations shown in Group P in Table 7. In some embodiments, the activatable anti-PD-1 antibody includes a combination of a heavy chain variable region sequence and a light chain variable region sequence from the combinations shown in Group Q in Table 7.

In some embodiments, the activatable anti-PD-1 antibody includes a combination of the complementarity determining region (CDR) sequences of a heavy chain sequence from the heavy chain sequences shown in Group A in Table 7. In some embodiments, the activatable anti-PD-1 antibody includes a combination of the CDRs of a light chain sequence from the light chain sequences shown in Group A in Table 7. In some embodiments, the activatable anti-PD-1 antibody includes a combination of the CDRs of a heavy chain sequence from the heavy chain sequences shown in Group A in Table 7 and the CDRs of a light chain sequence from the heavy chain sequences shown in Group A in Table 7.

In some embodiments, the activatable anti-PD-1 antibody includes a combination of CDRs of a heavy chain sequence from the heavy chain sequences shown in Group B in Table 7. In some embodiments, the activatable anti-PD-1 antibody includes a combination of the CDRs of a light chain sequence from the light chain sequences shown in Group B in Table 7. In some embodiments, the activatable anti-PD-1 antibody includes a combination of the CDRs of a heavy chain sequence from the heavy chain sequences shown in Group B in Table 7 and the CDRs of a light chain sequence from the heavy chain sequences shown in Group B in Table 7.

In some embodiments, the activatable anti-PD-1 antibody includes a combination of the CDRs of a heavy chain sequence from the heavy chain sequences shown in Group C in Table 7. In some embodiments, the activatable anti-PD-1 antibody includes a combination of the CDRs of a light chain sequence from the light chain sequences shown in Group C in Table 7. In some embodiments, the activatable anti-PD-1 antibody includes a combination of the CDRs of a heavy chain sequence from the heavy chain sequences shown in Group C in Table 7 and the CDRs of a light chain sequence from the heavy chain sequences shown in Group C in Table 7.

In some embodiments, the activatable anti-PD-1 antibody includes a combination of the CDRs of a heavy chain sequence from the heavy chain sequences shown in Group D in Table 7. In some embodiments, the activatable anti-PD-1 antibody includes a combination of the CDRs of a light chain sequence from the light chain sequences shown in Group D in Table 7. In some embodiments, the activatable anti-PD-1 antibody includes a combination of the CDRs of a heavy chain sequence from the heavy chain sequences shown in Group D in Table 7 and the CDRs of a light chain sequence from the heavy chain sequences shown in Group D in Table 7.

In some embodiments, the activatable anti-PD-1 antibody includes a combination of the CDRs of a heavy chain sequence from the heavy chain sequences shown in Group E in Table 7. In some embodiments, the activatable anti-PD-1 antibody includes a combination of the CDRs of a light chain sequence from the light chain sequences shown in Group E in Table 7. In some embodiments, the activatable anti-PD-1 antibody includes a combination of the CDRs of a heavy chain sequence from the heavy chain sequences shown in Group E in Table 7 and the CDRs of a light chain sequence from the heavy chain sequences shown in Group E in Table 7.

In some embodiments, the activatable anti-PD-1 antibody includes a combination of the CDRs of a heavy chain sequence from the heavy chain sequences shown in Group F in Table 7. In some embodiments, the activatable anti-PD-1 antibody includes a combination of the CDRs of a light chain sequence from the light chain sequences shown in Group F in Table 7. In some embodiments, the activatable anti-PD-1 antibody includes a combination of the CDRs of a heavy chain sequence from the heavy chain sequences shown in Group F in Table 7 and the CDRs of a light chain sequence from the heavy chain sequences shown in Group F in Table 7.

In some embodiments, the activatable anti-PD-1 antibody includes a combination of the CDRs of a heavy chain sequence from the heavy chain sequences shown in Group G in Table 7. In some embodiments, the activatable anti-PD-1 antibody includes a combination of the CDRs of a light chain sequence from the light chain sequences shown in Group G in Table 7. In some embodiments, the activatable anti-PD-1 antibody includes a combination of the CDRs of a heavy chain sequence from the heavy chain sequences shown in Group G in Table 7 and the CDRs of a light chain sequence from the heavy chain sequences shown in Group G in Table 7.

In some embodiments, the activatable anti-PD-1 antibody includes a combination of the CDRs of a heavy chain sequence from the heavy chain sequences shown in Group H in Table 7. In some embodiments, the activatable anti-PD-1 antibody includes a combination of the CDRs of a light chain sequence from the light chain sequences shown in Group H in Table 7. In some embodiments, the activatable anti-PD-1 antibody includes a combination of the CDRs of a heavy chain sequence from the heavy chain sequences shown in Group H in Table 7 and the CDRs of a light chain sequence from the heavy chain sequences shown in Group H in Table 7.

In some embodiments, the activatable anti-PD-1 antibody includes a combination of the CDRs of a heavy chain sequence from the heavy chain sequences shown in Group I in Table 7. In some embodiments, the activatable anti-PD-1 antibody includes a combination of the CDRs of a light chain sequence from the light chain sequences shown in Group I in Table 7. In some embodiments, the activatable anti-PD-1 antibody includes a combination of the CDRs of a heavy chain sequence from the heavy chain sequences shown in Group I in Table 7 and the CDRs of a light chain sequence from the heavy chain sequences shown in Group I in Table 7.

In some embodiments, the activatable anti-PD-1 antibody includes a combination of the CDRs of a heavy chain sequence from the heavy chain sequences shown in Group J in Table 7. In some embodiments, the activatable anti-PD-1 antibody includes a combination of the CDRs of a light chain sequence from the light chain sequences shown in Group J in Table 7. In some embodiments, the activatable anti-PD-1 antibody includes a combination of the CDRs of a heavy chain sequence from the heavy chain sequences shown in Group J in Table 7 and the CDRs of a light chain sequence from the heavy chain sequences shown in Group J in Table 7.

In some embodiments, the activatable anti-PD-1 antibody includes a combination of the CDRs of a heavy chain sequence from the heavy chain sequences shown in Group K in Table 7. In some embodiments, the activatable anti-PD-1 antibody includes a combination of the CDRs of a light chain sequence from the light chain sequences shown in Group K in Table 7. In some embodiments, the activatable anti-PD-1 antibody includes a combination of the CDRs of a heavy chain sequence from the heavy chain sequences shown in Group K in Table 7 and the CDRs of a light chain sequence from the heavy chain sequences shown in Group K in Table 7.

In some embodiments, the activatable anti-PD-1 antibody includes a combination of the CDRs of a heavy chain sequence from the heavy chain sequences shown in Group L in Table 7. In some embodiments, the activatable anti-PD-1 antibody includes a combination of the CDRs of a light chain sequence from the light chain sequences shown in Group L in Table 7. In some embodiments, the activatable anti-PD-1 antibody includes a combination of the CDRs of a heavy chain sequence from the heavy chain sequences shown in Group L in Table 7 and the CDRs of a light chain sequence from the heavy chain sequences shown in Group L in Table 7.

In some embodiments, the activatable anti-PD-1 antibody includes a combination of the CDRs of a heavy chain sequence from the heavy chain sequences shown in Group M in Table 7. In some embodiments, the activatable anti-PD-1 antibody includes a combination of the CDRs of a light chain sequence from the light chain sequences shown in Group M in Table 7. In some embodiments, the activatable anti-PD-1 antibody includes a combination of the CDRs of a heavy chain sequence from the heavy chain sequences shown in Group M in Table 7 and the CDRs of a light chain sequence from the heavy chain sequences shown in Group M in Table 7.

In some embodiments, the activatable anti-PD-1 antibody includes a combination of the CDRs of a heavy chain sequence from the heavy chain sequences shown in Group N in Table 7. In some embodiments, the activatable anti-PD-1 antibody includes a combination of the CDRs of a light chain sequence from the light chain sequences shown in Group N in Table 7. In some embodiments, the activatable anti-PD-1 antibody includes a combination of the CDRs of a heavy chain sequence from the heavy chain sequences shown in Group N in Table 7 and the CDRs of a light chain sequence from the heavy chain sequences shown in Group N in Table 7.

In some embodiments, the activatable anti-PD-1 antibody includes a combination of the CDRs of a heavy chain sequence from the heavy chain sequences shown in Group O in Table 7. In some embodiments, the activatable anti-PD-1 antibody includes a combination of the CDRs of a light chain sequence from the light chain sequences shown in Group O in Table 7. In some embodiments, the activatable anti-PD-1 antibody includes a combination of the CDRs of a heavy chain sequence from the heavy chain sequences shown in Group O in Table 7 and the CDRs of a light chain sequence from the heavy chain sequences shown in Group O in Table 7.

In some embodiments, the activatable anti-PD-1 antibody includes a combination of the CDRs of a heavy chain sequence from the heavy chain sequences shown in Group P in Table 7. In some embodiments, the activatable anti-PD-1 antibody includes a combination of the CDRs of a light chain sequence from the light chain sequences shown in Group P in Table 7. In some embodiments, the activatable anti-PD-1 antibody includes a combination of the CDRs of a heavy chain sequence from the heavy chain sequences shown in Group P in Table 7 and the CDRs of a light chain sequence from the heavy chain sequences shown in Group P in Table 7.

In some embodiments, the activatable anti-PD-1 antibody includes a combination of the CDRs of a heavy chain sequence from the heavy chain sequences shown in Group Q in Table 7. In some embodiments, the activatable anti-PD-1 antibody includes a combination of the CDRs of a light chain sequence from the light chain sequences shown in Group Q in Table 7. In some embodiments, the activatable anti-PD-1 antibody includes a combination of the CDRs of a heavy chain sequence from the heavy chain sequences shown in Group Q in Table 7 and the CDRs of a light chain sequence from the heavy chain sequences shown in Group Q in Table 7.

In some embodiments, the activatable anti-PD-1 antibody includes a combination of the CDRs of a heavy chain sequence from the heavy chain sequences shown in Group R in Table 7. In some embodiments, the activatable anti-PD-1 antibody includes a combination of the CDRs of a light chain sequence from the light chain sequences shown in Group R in Table 7. In some embodiments, the activatable anti-PD-1 antibody includes a combination of the CDRs of a heavy chain sequence from the heavy chain sequences shown in Group R in Table 7 and the CDRs of a light chain sequence from the heavy chain sequences shown in Group R in Table 7.

In some embodiments, the activatable anti-PD-1 antibody includes a combination of the CDRs of a heavy chain sequence from the heavy chain sequences shown in Group S in Table 7. In some embodiments, the activatable anti-PD-1 antibody includes a combination of the CDRs of a light chain sequence from the light chain sequences shown in Group S in Table 7. In some embodiments, the activatable anti-PD-1 antibody includes a combination of the CDRs of a heavy chain sequence from the heavy chain sequences shown in Group S in Table 7 and the CDRs of a light chain sequence from the heavy chain sequences shown in Group S in Table 7.

In some embodiments, the activatable anti-PD-1 antibody includes a combination of the CDRs of a heavy chain sequence from the heavy chain sequences shown in Group T in Table 7. In some embodiments, the activatable anti-PD-1 antibody includes a combination of the CDRs of a light chain sequence from the light chain sequences shown in Group T in Table 7. In some embodiments, the activatable anti-PD-1 antibody includes a combination of the CDRs of a heavy chain sequence from the heavy chain sequences shown in Group T in Table 7 and the CDRs of a light chain sequence from the heavy chain sequences shown in Group T in Table 7.

In some embodiments, the activatable anti-PD-1 antibody includes a combination of the CDRs of a heavy chain sequence from the heavy chain sequences shown in Group U in Table 7. In some embodiments, the activatable anti-PD-1 antibody includes a combination of the CDRs of a light chain sequence from the light chain sequences shown in Group U in Table 7. In some embodiments, the activatable anti-PD-1 antibody includes a combination of the CDRs of a heavy chain sequence from the heavy chain sequences shown in Group U in Table 7 and the CDRs of a light chain sequence from the heavy chain sequences shown in Group U in Table 7.

In some embodiments, the activatable anti-PD-1 antibody includes a combination of the CDRs of a heavy chain sequence from the heavy chain sequences shown in Group V in Table 7. In some embodiments, the activatable anti-PD-1 antibody includes a combination of the CDRs of a light chain sequence from the light chain sequences shown in Group V in Table 7. In some embodiments, the activatable anti-PD-1 antibody includes a combination of the CDRs of a heavy chain sequence from the heavy chain sequences shown in Group V in Table 7 and the CDRs of a light chain sequence from the heavy chain sequences shown in Group V in Table 7.

In some embodiments, the activatable anti-PD-1 antibody includes a combination of the CDRs of the heavy chain sequence of SEQ ID NO: 619 and a combination of the CDRs of the light chain sequence of SEQ ID NO: 1856 as shown in Group V in Table 7. In some embodiments, the activatable anti-PD-1 antibody includes a combination of the heavy chain sequence of SEQ ID NO: 619 and the light chain sequence of SEQ ID NO: 1856 as shown in Group V in Table 7.

In some embodiments, the activatable anti-PD-1 antibody includes a combination of the CDRs of the heavy chain sequence of SEQ ID NO: 1846 and a combination of the CDRs of the light chain sequence of SEQ ID NO: 1858 as shown in Group V in Table 7. In some embodiments, the activatable anti-PD-1 antibody includes a combination of the heavy chain sequence of SEQ ID NO: 1846 and the light chain sequence of SEQ ID NO: 1858 as shown in Group V in Table 7.

In some embodiments, the activatable anti-PD-1 antibody includes a combination of the CDRs of the heavy chain sequence of SEQ ID NO: 1843 and a combination of the CDRs of the light chain sequence of SEQ ID NO: 1859 as shown in Group V in Table 7. In some embodiments, the activatable anti-PD-1 antibody includes a combination of the heavy chain sequence of SEQ ID NO: 1843 and the light chain sequence of SEQ ID NO: 1859 as shown in Group V in Table 7.

In some embodiments, the activatable anti-PD-1 antibody includes a combination of the CDRs of the heavy chain sequence of SEQ ID NO: 1847 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1847 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1848 and a combination of the CDRs of the light chain sequence of SEQ ID NO: 1860 as shown in Group V in Table 7. In some embodiments, the activatable anti-PD-1 antibody includes a combination of the heavy chain sequence of SEQ ID NO: 1848 and the light chain sequence of SEQ ID NO: 1860 as shown in Group V in Table 7.

In some embodiments, the activatable anti-PD-1 antibody includes a combination of the CDRs of the heavy chain sequence of SEQ ID NO: 1844 and a combination of the CDRs of the light chain sequence of SEQ ID NO: 1861 as shown in Group V in Table 7. In some embodiments, the activatable anti-PD-1 antibody includes a combination of the heavy chain sequence of SEQ ID NO: 1844 and the light chain sequence of SEQ ID NO: 1861 as shown in Group V in Table 7.

In some embodiments, the activatable anti-PD-1 antibody includes a combination of the CDRs of the heavy chain sequence of SEQ ID NO: 1841 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1841 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1842 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1842 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1845 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1845 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1835 and a combination of the CDRs of the light chain sequence of SEQ ID NO: 1857 as shown in Group V in Table 7. In some embodiments, the activatable anti-PD-1 antibody includes a combination of the heavy chain sequence of SEQ ID NO: 1835 and the light chain sequence of SEQ ID NO: 1857 as shown in Group V in Table 7.

In some embodiments, the activatable anti-PD-1 antibody includes a combination of the CDRs of the heavy chain sequence of SEQ ID NO: 1836 and a combination of the CDRs of the light chain sequence of SEQ ID NO: 1862 as shown in Group V in Table 7. In some embodiments, the activatable anti-PD-1 antibody includes a combination of the heavy chain sequence of SEQ ID NO: 1836 and the light chain sequence of SEQ ID NO: 1862 as shown in Group V in Table 7.

In some embodiments, the activatable anti-PD-1 antibody includes a combination of the CDRs of the heavy chain sequence of SEQ ID NO: 1837 and a combination of the CDRs of the light chain sequence of SEQ ID NO: 1863 as shown in Group V in Table 7. In some embodiments, the activatable anti-PD-1 antibody includes a combination of the heavy chain sequence of SEQ ID NO: 1837 and the light chain sequence of SEQ ID NO: 1863 as shown in Group V in Table 7.

In some embodiments, the activatable anti-PD-1 antibody includes a combination of the CDRs of the heavy chain sequence of SEQ ID NO: 1838 and a combination of the CDRs of the light chain sequence of SEQ ID NO: 1864 as shown in Group V in Table 7. In some embodiments, the activatable anti-PD-1 antibody includes a combination of the heavy chain sequence of SEQ ID NO: 1838 and the light chain sequence of SEQ ID NO: 1864 as shown in Group V in Table 7.

In some embodiments, the activatable anti-PD-1 antibody includes a combination of the CDRs of the heavy chain sequence of SEQ ID NO: 1838 and a combination of the CDRs of the light chain sequence of SEQ ID NO: 1865 as shown in Group V in Table 7. In some embodiments, the activatable anti-PD-1 antibody includes a combination of the heavy chain sequence of SEQ ID NO: 1838 and the light chain sequence of SEQ ID NO: 1865 as shown in Group V in Table 7.

In some embodiments, the activatable anti-PD-1 antibody includes a combination of the CDRs of the heavy chain sequence of SEQ ID NO: 1839 and a combination of the CDRs of the light chain sequence of SEQ ID NO: 1864 as shown in Group V in Table 7. In some embodiments, the activatable anti-PD-1 antibody includes a combination of the heavy chain sequence of SEQ ID NO: 1839 and the light chain sequence of SEQ ID NO: 1864 as shown in Group V in Table 7.

In some embodiments, the activatable anti-PD-1 antibody includes a combination of the CDRs of the heavy chain sequence of SEQ ID NO: 1839 and a combination of the CDRs of the light chain sequence of SEQ ID NO: 1865 as shown in Group V in Table 7. In some embodiments, the activatable anti-PD-1 antibody includes a combination of the heavy chain sequence of SEQ ID NO: 1839 and the light chain sequence of SEQ ID NO: 1865 as shown in Group V in Table 7.

In some embodiments, the activatable anti-PD-1 antibody includes a combination of the CDRs of the heavy chain sequence of SEQ ID NO: 1840 and a combination of the CDRs of the light chain sequence of SEQ ID NO: 1866 as shown in Group V in Table 7. In some embodiments, the activatable anti-PD-1 antibody includes a combination of the heavy chain sequence of SEQ ID NO: 1840 and the light chain sequence of SEQ ID NO: 1866 as shown in Group V in Table 7.

In some embodiments, the activatable anti-PD-1 antibody includes a combination of the CDRs of the heavy chain sequence of SEQ ID NO: 1841 and a combination of the CDRs of the light chain sequence of SEQ ID NO: 1867 as shown in Group V in Table 7. In some embodiments, the activatable anti-PD-1 antibody includes a combination of the heavy chain sequence of SEQ ID NO: 1841 and the light chain sequence of SEQ ID NO: 1867 as shown in Group V in Table 7.

In some embodiments, the activatable anti-PD-1 antibody includes a combination of the CDRs of the heavy chain sequence of SEQ ID NO: 1841 and a combination of the CDRs of the light chain sequence of SEQ ID NO: 1868 as shown in Group V in Table 7. In some embodiments, the activatable anti-PD-1 antibody includes a combination of the heavy chain sequence of SEQ ID NO: 1841 and the light chain sequence of SEQ ID NO: 1868 as shown in Group V in Table 7.

In some embodiments, the activatable anti-PD-1 antibody includes a combination of the CDRs of the heavy chain sequence of SEQ ID NO: 1849 and a combination of the CDRs of the light chain sequence of SEQ ID NO: 1858 as shown in Group V in Table 7. In some embodiments, the activatable anti-PD-1 antibody includes a combination of the heavy chain sequence of SEQ ID NO: 1849 and the light chain sequence of SEQ ID NO: 1858 as shown in Group V in Table 7.

In some embodiments, the activatable anti-PD-1 antibody includes a combination of the CDRs of the heavy chain sequence of SEQ ID NO: 1853 and a combination of the CDRs of the light chain sequence of SEQ ID NO: 1859 as shown in Group V in Table 7. In some embodiments, the activatable anti-PD-1 antibody includes a combination of the heavy chain sequence of SEQ ID NO: 1853 and the light chain sequence of SEQ ID NO: 1859 as shown in Group V in Table 7.

In some embodiments, the activatable anti-PD-1 antibody includes a combination of the CDRs of the heavy chain sequence of SEQ ID NO: 1869 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1869 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1850 and a combination of the CDRs of the light chain sequence of SEQ ID NO: 1860 as shown in Group V in Table 7. In some embodiments, the activatable anti-PD-1 antibody includes a combination of the heavy chain sequence of SEQ ID NO: 1850 and the light chain sequence of SEQ ID NO: 1860 as shown in Group V in Table 7.

In some embodiments, the activatable anti-PD-1 antibody includes a combination of the CDRs of the heavy chain sequence of SEQ ID NO: 1851 and a combination of the CDRs of the light chain sequence of SEQ ID NO: 1861 as shown in Group V in Table 7. In some embodiments, the activatable anti-PD-1 antibody includes a combination of the heavy chain sequence of SEQ ID NO: 1851 and the light chain sequence of SEQ ID NO: 1861 as shown in Group V in Table 7.

In some embodiments, the activatable anti-PD-1 antibody includes a combination of the CDRs of the heavy chain sequence of SEQ ID NO: 1852 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1852 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1854 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1854 and the light chain sequence of SEQ ID NO: 737 as shown in Group V in Table 7.

In some embodiments, the activatable anti-PD-1 antibody includes a combination of the CDRs of the heavy chain sequence of SEQ ID NO: 1855 and a combination of the CDRs of the light chain sequence of SEQ ID NO: 737 as shown in Group V in Table 7. In some embodiments, the activatable anti-PD-1 antibody includes a combination of the heavy chain sequence of SEQ ID NO: 1855 and the light chain sequence of SEQ ID NO: 737 as shown in Group V in Table 7.

In some embodiments, the activatable anti-PD-1 antibody includes a combination of the CDRs of a heavy chain sequence from the heavy chain sequences shown in Group W in Table 7. In some embodiments, the activatable anti-PD-1 antibody includes a combination of the CDRs of a light chain sequence from the light chain sequences shown in Group W in Table 7. In some embodiments, the activatable anti-PD-1 antibody includes a combination of the CDRs of a heavy chain sequence from the heavy chain sequences shown in Group W in Table 7 and the CDRs of a light chain sequence from the heavy chain sequences shown in Group W in Table 7.

TABLE 7

Variable Heavy Chain Region (VH) and Variable Light Chain Region (VL) Sequences for Activatable Antibodies that Bind PD-1

Group A

VH QVQLVESGGDVVQPGGSLRLSCAASGVAFSNYGMHWVRQAPGKGLEWVAVIWYDGSNKYYADSVKGRFTISR
DNSKNMLYLQMNSLRAEDTAMYYCARNDDYWGQGTLVTVSS (SEQ ID NO: 615)

VH QVQLVESGGDVVQPGRSLRLSCAASGLTFTNYGFHWVRQAPGKGLEWVAVIWYDGSKKYYADSVKGRFTISR
DNSKNTLYLQMNNLRAEDTAVYYCATGDDYWGQGTLVTVSS (SEQ ID NO: 617)

VH QVYLVESGGGVVQPGRSLRLSCAASGFTFSNYGMHWVRQAPGKGLEWVALIWYDGSNKYYADSVKGRFTISR
DNSKNTLYLQMTSLRVEDTAVYYCASNVDHWGQGTLVTVSS (SEQ ID NO: 618)

VH QVQLVESGGGVVQPGRSLRLDCKASGITFSNSGMHWVRQAPGKGLEWVAVIWYDGSKRYYADSVKGRFTISR
DNSKNTLFLQMNSLRAEDTAVYYCATNDDYWGQGTLVTVSS (SEQ ID NO: 1346)

VH QLQLQESGPGLVKPSETLSLTCTVSGGSLSRSSFFWGWIRQPPGKGLEWIGSIYYSGSTYYNPSLKSRVTIS
VDTSKNQFSLKLSSVTAADTAVYYCVRDYDILTGDEDYWGQGTLVTVSS (SEQ ID NO: 620)

VH QVQLVESGGGVVQPGRSLRLSCTTSGITFSSYGFHWVRQAPGKGLEWVAVIWYDGSKKYYADSVKGRFTLSR
DDSKNTLYLQMNSLRAEDTAVYYCVTGDDYWGQGTLVTVSS (SEQ ID NO: 621)

VH QLQLQESGPGLVKPSETLSLTCSVSGGSLSRSSYFWGWIRQPPGKGLEWIASIFYSGETYFNPSLKSRVTIS
VDTSRNQFSLKLSSVTAADTAVYYCARDYDILTGDEDYWGQGTLVTVSS (SEQ ID NO: 623)

VL EIVLTQSPATLSLSPGERATLSCRASQSVSSYLAWYQQKPGQAPRLIIYDASNRATGIPARFSGSGSGTDFT
LTISSLEPEDFAVYYCQQRSNWPLTFGGGTKVEIK (SEQ ID NO: 624)

VL EIVLTQSPATLSLSPGERATLSCRASQSVSSYLAWYQQKPGQAPRLLIYDTSNRATGIPARFSGSGSGTDFT
LTISSLEPEDFAVYYCQQRSNWPLTFGGGTKVEIK (SEQ ID NO: 625)

VL EIVLTQSPATLSLSPGERATLSCRASQSVSSYLAWYQQKPGQAPRLLIYDASNRATGIPARFSGSGSGTDFT
LTISSLEPEDFAVYYCQQSSNWPRTFGQGTKVEIK (SEQ ID NO: 626)

VL DIQMTQSPSSLSASVGDRVSITCRASQGISSWLAWYQQKPEKAPKSLIYAASNLRSGVPSRFSGSGSGTDFT
LTISSLQPEDFATYYCQQYYSYPRTFGQGTKVEIK (SEQ ID NO: 628)

VL EIVLTQSPATLSLSPGERATLSCRASQSVSSYLAWYQQKPGQAPRLLIYDASNRATGIPARFSGSGSGTDFT
LTISSLEPEDFAVYYCQQRSNWPLTFGGGTKVEIK (SEQ ID NO: 629)

TABLE 7-continued

Variable Heavy Chain Region (VH) and Variable Light Chain Region
(VL) Sequences for Activatable Antibodies that Bind PD-1

VL DIQMTQSPSSLSASVGDRVTITCRASQGISSWLAWYQQKPEKAPKSLIYAASSLQSGVPSRFSGSGSGTDFT
LTISSLQPEDFATYYCQQYYSYPRTFGQGTKVEIK (SEQ ID NO: 630)

Group B

VH QVQLQQPGAELVKPGASVKLSCKASGYTFTSYYLYWMKQRPGQGLEWIGGVNPSNGGTNFSEKFKSKATLTV
DKSSSTAYMQLSSLTSEDSAVYYCTRRDSNYDGGFDYWGQGTTLTVSSAK (SEQ ID NO: 631)

VH QVQLQQPGAELVKPGTSVKLSCKASGYTFTNYYMYWVKQRPGQGLEWIGGINPSNGGTNFNEKFKNKATLTV
DSSSSTTYMQLSSLTSEDSAVYYCTRRDYRFDMGFDYWGQGTTLTVSSAK (SEQ ID NO: 632)

VH MDWTWSILFLVAAPTGAHSQVQLVQSGVEVKKPGASVKVSCKASGYTFTNYYMYWVRQAPGQGLEWMGGINP
SNGGTNFNEKFKNRVTLTTDSSTTTAYMELKSLQFDDTAVYYCARRDYRFDMGFDYWGQGTTVTVSS (SEQ
ID NO: 633)

VH QVQLVQSGVEVKKPGASVKVSCKASGYTFTNYYMYWVRQAPGQGLEWMGGINPSNGGTNFNEKFKNRVTLTT
DSSTTTAYMELKSLQFDDTAVYYCARRDYRFDMGFDYWGQGTTVTVSS (SEQ ID NO: 634)

VH EVQLVLSGGGFVQPGGSLKLSCAASGFTFSSYAMSWVRQNPERRLVWVATITGGGRNTYYPDSVKGRFTISR
DNAKNTLYLQMSSLRSEDTAMYYCTRQGYDGYTWFAYWGQGTLVTVS (627)

VL DIVLTQSPTSLAVSLGQRATISCRASKSVSTSGFSYLHWYQQKPGQPPKLLIFLASNLESGVPARFSGSGSG
TDFTLNIHPVEEEDAATYYCQHSWELPLTFGAGTKLELK (SEQ ID NO: 635)

VL DIVLTQSPASLAVSLGQRAAISCRASKGVSTSGYSYLHWYQQKPGQSPKLLIYLASYLESGVPARFSGSGSG
TDFTLNIHPVEEEDAATYYCQHSRDLPLTFGTGTKLELK (SEQ ID NO: 636)

VL MAPVQLLGLLVLFLPAMRCEIVLTQSPATLSLSPGERATLSCRASKGVSTSGYSYLHWYQQKPGQAPRLLIY
LASYLESGVPARFSGSGSGTDFTLTISSLEPEDFAVYYCQHSRDLPLTFGGGTKVEIK (SEQ ID
NO: 637)

VL EIVLTQSPATLSLSPGERATLSCRASKGVSTSGYSYLHWYQQKPGQAPRLLIYLASYLESGVPARFSGSGSG
TDFTLTISSLEPEDFAVYYCQHSRDLPLTFGGGTKVEIK (SEQ ID NO: 638)

VL MAPVQLLGLLVLFLPAMRCEIVLTQSPLSLPVTPGEPASISCRASKGVSTSGYSYLHWYLQKPGQSPQLLIY
LASYLESGVPDRFSGSGSGTDFTLKISRVEAEDVGVYYCQHSRDLPLTFGQGTKLEIK (SEQ ID
NO: 639)

VL EIVLTQSPLSLPVTPGEPASISCRASKGVSTSGYSYLHWYLQKPGQSPQLLIYLASYLESGVPDRFSGSGSG
TDFTLKISRVEAEDVGVYYCQHSRDLPLTFGQGTKLEIK (SEQ ID NO: 640)

VL MAPVQLLGLLVLFLPAMRCDIVMTQTPLSLPVTPGEPASISCRASKGVSTSGYSYLHWYLQKPGQSPQLLIY
LASYLESGVPDRFSGSGSGTAFTLKISRVEAEDVGLYYCQHSRDLPLTFGQGTKLEIK (SEQ ID
NO: 641)

VL DIVMTQTPLSLPVTPGEPASISCRASKGVSTSGYSYLHWYLQKPGQSPQLLIYLASYLESGVPDRFSGSGSG
TAFTLKISRVEAEDVGLYYCQHSRDLPLTFGQGTKLEIK (SEQ ID NO: 642)

VL DIVLTQSPTSLAVSLGQRATISCRASESVDNSGISFMNWFQQKPGQPPKLLIYAASNPGSGVPARFSGSGSG
TDFSLNIHPMEEDDTAMYFCQQSKEVPWTFGGGTELEIKR (SEQ ID NO: 725)

HC MAVLGLLFCLVTFPSCVLSQVQLVQSGVEVKKPGASVKVSCKASGYTFTNYYMYWVRQAPGQGLEWMGGINP
SNGGTNFNEKFKNRVTLTTDSSTTTAYMELKSLQFDDTAVYYCARRDYRFDMGFDYWGQGTTVTVSSASTKG
PSVFPLAPCSRSTSESTAALGCLVKDYFPEPVTVSWNSGALTSGVHTFPAVLQSSGLYSLSSVVTVPSSSLG
TKTYTCNVDHKPSNTKVDKRVESKYGPPCPPCPAPEFLGGPSVFLFPPKPKDTLMISRTPEVTCVVVDVSQE
DPEVQFNWYVDGVEVHNAKTKPREEQFNSTYRVVSVLTVLHQDWLNGKEYKCKVSNKGLPSSIEKTISKAKG
QPREPQVYTLPPSQEEMTKNQVSLTCLVKGFYPSDIAVEWESNGQPENNYKTTPPVLDSDGSFFLYSRLTVD
KSRWQEGNVFSCSVMHEALHNHYTQKSLSLSLGK (SEQ ID NO: 643)

HC QVQLVQSGVEVKKPGASVKVSCKASGYTFTNYYMYWVRQAPGQGLEWMGGINPSNGGTNFNEKFKNRVTLTT
DSSTTTAYMELKSLQFDDTAVYYCARRDYRFDMGFDYWGQGTTVTVSSASTKGPSVFPLAPCSRSTSESTAA
LGCLVKDYFPEPVTVSWNSGALTSGVHTFPAVLQSSGLYSLSSVVTVPSSSLGTKTYTCNVDHKPSNTKVDK
RVESKYGPPCPPCPAPEFLGGPSVFLFPPKPKDTLMISRTPEVTCVVVDVSQEDPEVQFNWYVDGVEVHNAK
TKPREEQFNSTYRVVSVLTVLHQDWLNGKEYKCKVSNKGLPSSIEKTISKAKGQPREPQVYTLPPSQEEMTK
NQVSLTCLVKGFYPSDIAVEWESNGQPENNYKTTPPVLDSDGSFFLYSRLTVDKSRWQEGNVFSCSVMHEAL
HNHYTQKSLSLSLGK (SEQ ID NO: 644)

HC MAVLGLLFCLVTFPSCVLSQVQLVQSGVEVKKPGASVKVSCKASGYTFTNYYMYWVRQAPGQGLEWMGGINP
SNGGTNFNEKFKNRVTLTTDSSTTTAYMELKSLQFDDTAVYYCARRDYRFDMGFDYWGQGTTVTVSSASTKG
PSVFPLAPSSKSTSGGTAALGCLVKDYFPEPVTVSWNSGALTSGVHTFPAVLQSSGLYSLSSVVTVPSSSLG
TQTYICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIEKTISK
AKGQPREPQVYTLPPSRDELTKNQVSLTCLVKGFYPSDIAVEWESNGQPENNYKTTPPVLDSDGSFFLYSKL
TVDKSRWQQGNVFSCSVMHEALHNHYTQKSLSLSPGK (SEQ ID NO: 645)

TABLE 7-continued

Variable Heavy Chain Region (VH) and Variable Light Chain Region
(VL) Sequences for Activatable Antibodies that Bind PD-1

HC QVQLVQSGVEVKKPGASVKVSCKASGYTFTNYYMYWVRQAPGQGLEWMGGINPSNGGTNFNEKFKNRVTLTT
DSSTTTAYMELKSLQFDDTAVYYCARRDYRFDMGFDYWGQGTTVTVSSASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDK
KVEPKSCDKTHTCPPCPAPELLGGPSVFLFPPKPKDTLMISRTPEVTCVVVDVSHEDPEVKFNWYVDGVEVH
NAKTKPREEQYNSTYRVVSVLTVLHQDWLNGKEYKCKVSNKALPAPIEKTISKAKGQPREPQVYTLPPSRDE
LTKNQVSLTCLVKGFYPSDIAVEWESNGQPENNYKTTPPVLDSDGSFFLYSKLTVDKSRWQQGNVFSCSVMH
EALHNHYTQKSLSLSPGK (SEQ ID NO: 646)

LC MAPVQLLGLLVLFLPAMRCEIVLTQSPATLSLSPGERATLSCRASKGVSTSGYSYLHWYQQKPGQAPRLLIY
LASYLESGVPARFSGSGSGTDFTLTISSLEPEDFAVYYCQHSRDLPLTFGGGTKVEIKRTVAAPSVFIFPPS
DEQLKSGTASVVCLLNNFYPREAKVQWKVDNALQSGNSQESVTEQDSKDSTYSLSSTLTLSKADYEKHKVYA
CEVTHQGLSSPVTKSFNRGEC (SEQ ID NO: 647)

LC EIVLTQSPATLSLSPGERATLSCRASKGVSTSGYSYLHWYQQKPGQAPRLLIYLASYLESGVPARFSGSGSG
TDFTLTISSLEPEDFAVYYCQHSRDLPLTFGGGTKVEIKRTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFNRG
EC (SEQ ID NO: 648)

LC MAPVQLLGLLVLFLPAMRCEIVLTQSPLSLPVTPGEPASISCRASKGVSTSGYSYLHWYLQKPGQSPQLLIY
LASYLESGVPDRFSGSGSGTDFTLKISRVEAEDVGVYYCQHSRDLPLTFGQGTKLEIKRTVAAPSVFIFPPS
DEQLKSGTASVVCLLNNFYPREAKVQWKVDNALQSGNSQESVTEQDSKDSTYSLSSTLTLSKADYEKHKVYA
CEVTHQGLSSPVTKSFNRGEC (SEQ ID NO: 649)

LC EIVLTQSPLSLPVTPGEPASISCRASKGVSTSGYSLHWYLQKPGQSPQLLIYLASYLESGVPDRFSGSGSG
TDFTLKISRVEAEDVGVYYCQHSRDLPLTFGQGTKLEIKRTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFNRG
EC (SEQ ID NO: 650)

LC MAPVQLLGLLVLFLPAMRCDIVMTQTPLSLPVTPGEPASISCRASKGVSTSGYSYLHWYLQKPGQSPQLLIY
LASYLESGVPDRFSGSGSGTAFTLKISRVEAEDVGLYYCQHSRDLPLTFGQGTKLEIKRTVAAPSVFIFPPS
DEQLKSGTASVVCLLNNFYPREAKVQWKVDNALQSGNSQESVTEQDSKDSTYSLSSTLTLSKADYEKHKVYA
CEVTHQGLSSPVTKSFNRGEC (SEQ ID NO: 651)

LC DIVMTQTPLSLPVTPGEPASISCRASKGVSTSGYSYLHWYLQKPGQSPQLLIYLASYLESGVPDRFSGSGSG
TAFTLKISRVEAEDVGLYYCQHSRDLPLTFGQGTKLEIKRTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFNRG
EC (SEQ ID NO: 652)

Group C

VH DVQLQESGPGLVKPSQSLSLTCTVTGYSITSDYAWNWIRQFPGNKLEWMGYINYSGSTSYNPSLKSRISITR
DTSKNQFFLQLNSVTTEDTATYYCARWIGSSAWYFDVWGAGTTVTV (SEQ ID NO: 726)

VL DVLMTQTPLSLPVSLGDQASISCRSGQNIVHSNGNTYLEWYLQKPGQSPKLLIYKVSNRFFGVPDRISGSGS
GTDFTLKISRVEAEDLGVYFCFQGSHVPFTFGSGTKLEIK (SEQ ID NO: 727)

VH QVQLQQPGAELVKPGASVKLSCKASGYTFTTYYLYWVRQRPGQGLEWIGGINPSNGGTNFNEKFKSKATLTV
DKSSSTAYMQLNSLTSEDSAVYYCTRRDYRYDRGFDYWGQGTSVTV (SEQ ID NO: 728)

VL DIVLTQSPASLAVSLGQRATISCRASKSVSTSGFNYIHWYQQKPGQPPKLLIYLASNLESGVPARFSGSGSG
TDFTLNIHPVEDEDAATYYCQHSRELPLTFGAGTKLEIK (SEQ ID NO: 729)

VH QVQLQQSGAELVKPGASVKMSCKAFGYTFTTYPIEWMKQNHGKSLEWIGNFHPYNDDTKYNEKFKGKAKLTV
EKSSTTVYLELSRLTSDDSAVYYCARENYGSHGGFVYWGQGTLVTV (SEQ ID NO: 730)

VL ENVLTQSPAIMSASPGEKVTMTCRASSSVISSYLHWYQQKSGASPKLWIYSTSNLASGVPDRFSGSGSGTSY
SLTISSVEAEDAATYYCQQYNGYPLTFGAGTKLEIK (SEQ ID NO: 731)

Group D

LFTVTVPKELYIIEHGSNVTLECNFDTGSHVNLGAITASLQKVENDTSPHRERATLLEEQLPLGKASFHIPQ
VQVRDEGQYQCIIIYGVAWDYKYLTLKVKASYRKINTHILKVPETDEVELTCQATGYPLAEVSWPNVSVPAN
TSHSRTPEGLYQVTSVLRLKPPPGRNFSCVFWNTHVRELTLASIDLQSMEPRTHPTWEPKSCDKTHTCPPC
PAPELLGGPSVFLFPPKPKDTLMISRTPEVTCVVVDVSHEDPEVKFNWYVDGVEVHNAKTKPREEQYNSTYR
VVSVLTVLHQDWLNGKEYKCKVSNKALPAPIEKTISKAKGQPREPQVYTLPPSRDELTKNQVSLTCLVKGFY
PSDIAVEWESNGQPENNYKTTPPVLDSDGSFFLYSKLTVDKSRWQQGNVFSCSVMHEALHNHYTQKSLSLSP
GK (SEQ ID NO: 732)

Group E

VH EVQLVQSGAEVKKPGASVKVSCKASGYRFTSYGISWVRQAPGQGLEWMGWISAYNGNTNYAQKLQGRVTMTT
DTSTNTAYMELRSLRSDDTAVYYCARDADYSSGSGYWGQGTLVTVSS (SEQ ID NO: 733)

VH QVQLVQSGAEVKKPGASVRVSCKASGYTLTSYYIHWVRQAPGQGLEWMGIINPRGATISYAQKFQGRVTMTR
DTSTSTVYMELRNLKSEDTALYYCATAGIYGFDFDYWGRGTLVTVSS (SEQ ID NO: 734)

TABLE 7-continued

Variable Heavy Chain Region (VH) and Variable Light Chain Region (VL) Sequences for Activatable Antibodies that Bind PD-1

VH QVQLQESGPGLVKPSQTLSLTCTVSGGSISSGAYYWSWIRQHPGKGLEWIGYIYYNGNTYYNPSLRSLVTIS
    VDASKNQFSLKLSSVTAADTAVYYCARASDYVWGGYRYMDAFDIWGRGTLITVSS (SEQ ID NO: 735)

VH GAHSEVQLVQSGGGVVQPGRSLRLSCAASGFTFSSYWCDRMSWVRQAPGKGLEWVSAISGSGGSTYYADSVK
    GRFTISRDNSKNTLYLQMNSLRAEDTAVYYCAKENWGSYFDLWGQGTTVTVSS (SEQ ID NO: 736)

VL SYELTQPPSVSVSPGQTARITCSGDALPKQYAYWYQQKPGQAPVMVIYKDTERPSGIPERFSGSSSGTKVTL
    TISGVQAEDEADYYCQSADNSITYRVFGGGTKVTVL (SEQ ID NO: 737)

VL QSALTQPASVSGSPGQSITISCTGTSNDVGGYNYVSWYQHHPGKAPKLIIYDVTNRPSGVSDRFSGSKSGNT
    ASLTISGLLAEDEGDYYCSSYTIVTNFEVLFGGGTKLTV (SEQ ID NO: 738)

VL QSVLTQPPSASGTPGQRVTISCSGSNSNIGSNSVNWYQQLPGTAPKLLIYGNNQRPSGVPDRFSGSKSGTSA
    SLAISGLQSENEADYYCAAWDDSLNGPVFGRGTKVTVLGE (SEQ ID NO: 739)

VL GVHSDIVMTQSPSTLSASVGDRVTITCRASQGISSWLAWYQQKPGRAPKVLIYKASTLESGVPSRFSGSGSG
    TDFTLTISSLQPEDFATYYCQQSYSTPWTFGQGTKLEIKR (SEQ ID NO: 740)

Group F

VH QVQLVQSGHEVKQPGASVKMSCKASGYSFTSSWIHWVKQAPGQGLEWIGYIYPSTGFTEYNQKFKDRATLTA
    DKSTSTAYMELSSLRSEDTAVYYCARWRDSSGYHAMDYWGQGTLVTVSS (SEQ ID NO: 741)

VH QVQLVQSGHEVKQPGASVKMSCKASGYSFTSSWIHWVRQAPGQGLEWIGYIYPSTGFTEYNQKFKDRATLTA
    DKSTSTAYMELSSLRSEDTAVYYCARWRDSSGYHAMDYWGQGTLVTVSS (SEQ ID NO: 742)

VL EIVLTQSPATLSLSPGQRLTISCRASQSVSTSGYSYMHWYQQKPDQSPKLLIKFGSNLESGIPARFSGSGSG
    TDFTLTISSLEPEDFATYYCQHSWEIPYTFGQGTKLEIK (SEQ ID NO: 743)

VL DIVLTQSPATLSLSPGQRLTISCRASQSVSTSGYSYMHWYQQKPDQSPKLLIKFGSNLESGIPARFSGSGSG
    TDFTLTISSLEPEDFAVYYCQHSWEIPYTFGQGTKLEIK (SEQ ID NO: 744)

Group H

VH QGQLVQSGAEVKKPGASVKVSCKASGYTFTDYEMHWVRQAPIHGLEWIGVIESETGGTAYNQKFKGRVTITA
    DKSTSTAYMELSSLRSEDTAVYYCAREGITTVATTYYWYFDVWGQGTTVTVSS (SEQ ID NO: 745)

VL DVVMTQSPLSLPVTLGQPASISCRSSQSIVHSNGNTYLEWYLQKPGQSPQLLIYKVSNRFSGVPDRFSGSGS
    GTDFTLKISRVEAEDVGVYYCFQGSHVPLTFGQGTKLEIK (SEQ ID NO: 746)

Group I

VH MGLGLQWVFFVALLKGVHCEVRLLESGGGLVKPEGSLKLSCVASGFTFSDYFMSWVRQAPGKGLEWVAHIYT
    KSYNYATYYSGSVKGRFTISRDDSRSMVYLQMNNLRTEDTATYYCTRDGSGYPSLDFWGQGTQVTVSSATTT
    APSVYPLAPACDSTTKS (SEQ ID NO: 747)

VL YELTQPPSASVNVGETVKITCSGDQLPKYFADWFHQRSDQTILQVIYDDNKRPSGIPERISGSSSGTTATLT
    IRDVRAEDEGDYYCFSGYVDSDSKLYVFGSGTQLTVLGGPKSSPKVTVFPPSPEELRTNKATLVCLVNDFYP
    GSATVTWKANGATINDGVKTTKPSKQGQNYMTSSYLSLTADQWKSHNRVSCQVTHEGETVEKSLSPAECL
    (SEQ ID NO: 748)

Bs METDTLLLWVLLLWVPGSTGDAAPQRRARRTKLGTELGSPGLQEFEVRLLESGGGLVKPEGSLKLSCVASG
Ab FTFSDYFMSWVRQAPGKGLEWVAHIYTKSYNYATYYSGSVKGRFTISRDDSRSMVYLQMNNLRTEDTATYYC
    TRDGSGYPSLDFWGQGTQVTVSSGGGGSDIQMTQSPSSLPASLGDRVTINCQASQDISNYLNWYQQKPGKAP
    KLLIYYTNKLADGVPSRFSGSGSGRDSSFTISSLESEDIGSYYCQQYNYPWTFGPGTKLEIKGGGGSGGGG
    SGGGGSEVQLVESGGGLVQPGKSLKLSCEASGFTFSGYGMHWVRQAPGRGLESVAYITSSSINIKYADAVKG
    RFTVSRDNAKNLLFLQMNILKSEDTAMYYCARFDWDKNYWGQGTMVTVSSGGGGSYELTQPPSASVNVGETV
    KITCSGDQLPKYFADWFHQRSDQTILQVIYDDNKRPSGIPERISGSSSGTTATLTIRDVRAEDEGDYYCFSG
    YVDSDSKLYVFGSGTQLTVLGPRGGPEQKLISEEDLNSAVDHHHHHH (SEQ ID NO: 749)

Group J

VH QLVQSGAEVKKPGASVKVSCKASGYTFTSYGISWVRQAPGQGLEWMGWISAYNGNTNYAQKLQGRVTMTTDT
    STSTATMELRSLRSDDTAVYYCARGRGYSYGIDAFDIWGQGTMVT (SEQ ID NO: 750)

VH LSYVLTQPPSVSVSPGQTARITCSGDALPKQYAYWYQQKPGQAPVLVIYKDSERPSGIPERFSGSSSGTTVT
    LTISGVQAEDEADYYCQSADSSGTYVVFGGGTKLTVLGQP (SEQ ID NO: 751)

Group K

VH QVQLQQSGPGLVRPSQTLSLSCDISGDSVSSNSATWNWIRQSPSRGLEWLGRTFYRSKWYHDYALSVKSRIT
    INPDTSKNQFSLQLNSVSPGDTAVYFCVREDIDGRLDYWGQGTLVTVSS (SEQ ID NO: 752)

VH QVQLVQSGSELKKPGASVKISCKASGYIFSDNGVNWVRQAPGQGLEWMGWINTKIGNPTYAQGFTGRFVFSL
    DTSVSTTYLQISSLQAGDTAVYYCAREHDYYYGMDVWGQGTTVTVSS (SEQ ID NO: 753)

TABLE 7-continued

Variable Heavy Chain Region (VH) and Variable Light Chain Region
(VL) Sequences for Activatable Antibodies that Bind PD-1

VH  MAEVQLLESGAEVKKPGASVKVSCKASGYTFTSHYMHWVRQAPGQGLEWMGVINPSGGSTSYAQKFQGRVTM
    TRDTSTSTVYMDLSSLRSEDTAVYYCARRSEAYYHGMDVWGQGTTVTVSS (SEQ ID NO: 754)

VH  EVQLVQSGSELKKPGASVKISCKASGYIFSDNGVNWVRQAPGQGLEWMGWINTKIGNPTYAQGFTGRFVFSL
    DTSISTTYLQISSLQAGDTAVYYCAREHDYYYGMDVWGQGTTVTVSS (SEQ ID NO: 755)

VH  QVQLVESGGGLVQPGGSLRLSCEATGFTFSRYWMHWVRQAPGKGLEWVSSISSSSSYIYYADSVKGRFTISR
    DNAKNSLYLQMNSLRAEDTAVYYCARDTLEYYGSGILENAMGYYGMDVWGQGTTVTVSS (SEQ ID
    NO: 756)

VH  EVQLVESGGGLVRPGGSLRLACAASGFSFSDYYMTWIRQAPGRGLEWIAYISDSGQTVHYADSVKGRFTISR
    DNTKNSLFLQVNTLRAEDTAVYYCAREDLLGYYLQSWGQGTLVTVSS (SEQ ID NO: 757)

VH  EVQLVESGGGVVQPGRSLRLSCAASGFTSSYWMSWVRQAPGKGLEWVANIKQDGSEKYYVDSVKGRFTISR
    DNAKNSLYLQMNSLRAEDTAVYYCAREGEHDAFDIWGQGTMVTVSS (SEQ ID NO: 758)

VH  QVQLVQSGSELKKPGASVKISCKASGYIFSDNGVNWVRQAPGQGLEWMGWINTKIGNPTYAQGFTGRFVFSL
    DTSVSTTYLQISSLQAGDTAVYYCAREHDYYYGMDVWGQGTTVTVSS (SEQ ID NO: 759)

VH  QVQLVQSGSELKKPGASVKISCKASGYIFSDNGVNWVRQAPGQGLEWMGWINTKIGNPTYAQGFTGRFVFSL
    DTSVSTTYLQISSLQAGDTAVYYCAREHDYYYGMDVWGQGTTVTVSS (SEQ ID NO: 760)

VH  QVQLVQSGAEVKKPGASVKVSCKASGYTFTRYTMHWVRQAPGQRLEWMGWINAGNGNTKYSQKFQGRVTITR
    DTSASTAYMELSSLRSEDTAVYYCAKVSAGTESWFDPWGQGTLVTVSS (SEQ ID NO: 761)

VH  QVQLVQSGAEVKKPGASVKVSCKASGYTFTSYGISWVRQAPGQGLEWMGWISAYNGNTNYAQKLQGRVTMTT
    DTSTSTAYMELRSLRSDDTAVYYCARGLYGDEDYWGQGTLVTVSS (SEQ ID NO: 762)

VH  QVQLVQSGSELKKPGASVKISCKASGYIFSDNGVNWVRQAPGQGLEWMGWINTKIGNPTYAQGFTGRFVFSL
    DTSISTTYLQISSLQAGDTAVYYCAREHDYYYGMDVWGQGTTVTVSS (SEQ ID NO: 763)

VH  QMQLVQSGAEVKKPGESLKISCKGSGYSFTSYWIGWVRQMPGKGLEWMGIIYPGDSDTRYSPSFQGQVTISA
    DKSISTAYLQWSSLKASDTAMYYCASGVTRKRYSSSWPPFDYWGQGTLVTVSS (SEQ ID NO: 764)

VH  QVQLQQWGAGLLKSSETLSLSCAVYGGTFRDDHWSWIRQPPGKGLEWIGESHHTGRTIYNPSLRSRVTMSID
    TSKNEFSLILRSVTAADTATYFCARGNNYVWGNQEDFWGQGTLVTVSS (SEQ ID NO: 765)

VH  QVQLQQSGPGLVRPSQTLSLSCDISGDSVSSNSATWNWIRQSPSRGLEWLGRTFYRSKWYHDYALSVKSRIT
    INPDTSKNQFSLQLNSVSPGDTAVYFCVREDIDGRLDYWGQGTLVTVSS (SEQ ID NO: 766)

VH  EVQLVESGGALVQPGGSLRLSCAVSGFTFSDHYMDWVRQAPGKGLEWVARSRNKGNSYTTEYAASVRGRFTI
    SRDDSKNSLYLQMNSLKTEDTAVYYCVRVGVVPALDGMDVWGQGTTVTVSS (SEQ ID NO: 767)

VH  EVQLVESGGGLVQPGGSLRLSCAASGFTSSYWMHWVRQAPGKGLEWVSSISSSSSYIYYADSVKGRFTISR
    DNAKNSLYLQMNSLRAEDTAVYYCARDTLEYYGSGILENAMGYYGMDVWGQGTTVTVSS (SEQ ID
    NO: 768)

VH  EVQLLESGGGVVQTGRSLRLSCSDSGSTERSQAMHWVRQTPGKGLEWLAVTSHDGSKTYYADSVKGRFTISR
    DNSKNTLYLQMNSLRGEDTAVYYCARGGRGYTYDHSFFDYWGQGTLVTVSS (SEQ ID NO: 769)

VH  QVQLVQSGSELKKPGASVKISCKASGYIFSDNGVNWVRQAPGQGLEWMGWINTKDGNPTYAQGFTGRFVFSL
    DTSISTTYLQISSLQAGDTAVYYCAREHDYYYGMDVWGQGTTVTVSS (SEQ ID NO: 770)

VH  QVQLVQSGSELKKPGASVKISCKASGYIFSDNGVNWVRQAPGQGLEWMGWINTKTGNPTYAQGFTGRFVFSL
    DTSISTTYLQISSLQAGDTAVYYCAREHDYYYGMDVWGQGTTVTVSS (SEQ ID NO: 771)

VH  QVQLVQSGSELKKPGASVKISCKASGYTFSDNGVNWVRQAPGQGLEWMGWINTKDGNPTYAQGFTGRFVFSL
    DTSISTTYLQISSLQAGDTAVYYCAREHDYYYGMDVWGQGTTVTVSS (SEQ ID NO: 772)

VH  QVQLVQSGSELKKPGASVKISCKASGYTFSDNGVNWVRQAPGQGLEWMGWINTKTGNPTYAQGFTGRFVFSL
    DTSISTTYLQISSLQAGDTAVYYCAREHDYYYGMDVWGQGTTVTVS (SEQ ID NO: 773)

VH  QVQLVQSGSELKKPGASVKISCKASGYKFSDNGVNWVRQAPGQGLEWMGWINTKSGNPTYAQGFTGRFVFSL
    DTSISTTYLQISSLQAGDTAVYYCAREHDYYYGMDVWGQGTTVTVSS (SEQ ID NO: 774)

VH  QVQLVQSGSELKKPGASVKISCKASGYTFSDNGVNWVRQAPGQGLEWMGWINTKSGNPTYAQGFTGRFVFSL
    DTSISTTYLQISSLQAGDTAVYYCAREHDYYYGMDVWGQGTTVTVSS (SEQ ID NO: 775)

VH  QVQLVQSGSELKKPGASVKISCKASGYKFSDNGVNWVRQAPGQGLEWMGWINTKDGNPTYAQGFTGRFVFSL
    DTSISTTYLQISSLQAGDTAVYYCAREHDYYYGMDVWGQGTTVTVSS (SEQ ID NO: 776)

VL  LPVLTQPASVSGSPGQSITISCTGTSSDVGGYNYVSWYQQHPGKAPKLMIYEVSKRPSGVPDRFSGSKSGNT
    ASLTVSGLQAEDEADYYCSAWDDSLNADVFGGGTKLTVL (SEQ ID NO: 777)

VL  QPVLTQPPSASGTPGQRVTISCSGSSSNIGTNTVNWYQQVPGTAPKLLIHGNDQRPSGVPDRFSGSKSDTSA
    SLAITGLQSDDDADYYCSAWDDSLNADVFGGGTKLTVL (SEQ ID NO: 778)

TABLE 7-continued

Variable Heavy Chain Region (VH) and Variable Light Chain Region (VL) Sequences for Activatable Antibodies that Bind PD-1

VL QAVLTQPPSASATPGQRVTISCSGSDSNIGTNYVYWYQQFPGTAPQPLIYRDNQRPSGVPDRFSGSKSGTSA
SLAISGLRSEDEATYFCSTWDDSLNGWVFGGGTKLTVL (SEQ ID NO: 779)

VL QPVLTQPRSVSGSPGQSITTSCTGTSSDVGGYNYVSWYQQHPGKAPKLMIYEVSNRPSGVSNRFSGSKSGNT
ASLTISGLQAEDEADYYCSSYTSSSTLEVFGTGTKVTVL (SEQ ID NO: 780)

VL YELMQPPSVSGAPGQRVTISCTGSSSNIGAAYDVHWYQQLPGKAPKLVMFANSNRPSGVPDRFSGSKSGTSA
SLAITGLQAEDEADYYCQSYDISLRAYVFGTGTKLTVL (SEQ ID NO: 781)

VL SYELMQPPSASGTPGQRVTISCSGSSSNIGTNTVNWYQHLPGTAPKLLIYSNNQRPSGVPDRFSGSKSGTSA
SLAISGLQSEDEADYYCATWDDSPNGWVFGGGTKLTVL (SEQ ID NO: 782)

VL QAVLTQPPSVSAAPGQRVTISCSGSNSNIADTYVSWYQQLPGTAPRLLIYDNDQRPSGIPDRFSGSKSGTSA
TLGITGLQTGDEADYYCGTWDSSLSGVFGTGTKVTVL (SEQ ID NO: 783)

VL QSVLTQPASVSGSPGQSVTISCTGSSSDVGAYNFVSWYRQYPGKAPKLLIYEVNKRPSDVPDRFSGSKFGNT
ASLTVSGLQADDEADYYCSSYAGSTDVFGTGTKVTVL (SEQ ID NO: 784)

VL LPVLTQPPSVSGTPGQRVTISCSGSSSNIGSNTVNWYQQLPGTAPKLLIYTNNQRPSGVPDRFSGSKSGTSA
SLAISGLQSEDEADYYCAAWDESLNGDVFGTGTKVTVL (SEQ ID NO: 785)

VL AIRMTQSPSFLSASVGDRVTITCRTSQNIYNYLNWYQQKPGKAPELLIFVASSLQSGVPSRFSGSGSGTDFT
LTISSLQPEDFATYFCLQDHSYPYTFGQGTKVEIK (SEQ ID NO: 786)

VL LPVLTQPPSVSEVPGQRVTISCSGGISNIGSNAVNWYQHFPGKAPKLLIYYNDLLPSGVSDRFSASKSGTSA
SLAISGLRSEDEADYYCAAWDDNLSAYVFATGTKVTVL (SEQ ID NO: 787)

VL QSALTQPPSASGSPGQSVTISCTGTSSDVGGYNYVSWYQHHPGKAPKLMIYEVSKRPSGVPDRFSGSKSAIT
ASLTISGLLTEDEADYYCSAWDDSLNADVFGGGTKVTVL (SEQ ID NO: 788)

VL DIQMTQSPSSLSASVGDRVTITCRASQSISTYLNWYQQKPGKAPKVLITDASSLETGVPSRFSGSGSGTDFT
FTISSLQPEDTATYFCQQYDDLPPTFGQGTKLEIK (SEQ ID NO: 789)

VL QAGLTQPRSVSGSPGQSVTISCTGTSSDVGGYNYVSWYQQHPGKAPKLMIYDVTKRPSGVSNRFSGSKSGNT
ASLTISGLQAEDEADYYCSSYTSSSTYVFGTGTKVTVL (SEQ ID NO: 790)

VL QPVLTQPASVSGSPGQSITISCTGTSSDVGGYNYVSWYQQHPGKAPKLMIYDVSNRPSGVSNRFSGSKSGNT
ASLAITGLQSDDDADYYCSAWDDSLNADVFGGGTKLTVL (SEQ ID NO: 791)

VL QAGLTQPPSVSKGLRQTATLTCTGNSNNIGDQGAAWLQQHQGHPPRLLSYRNNNRPSGISERLSASRSGNIA
SLTITGLQPEDEADYYCSAWDSSLSVWVFGGGTKLTVL (SEQ ID NO: 792)

VL QAVLTQPPSASGTPGQRVTISCSGSSSNIGSNTVNWYQQLPGTAPKLLIYSNNQRPSGVPDRFSGSKSGTSA
SLAISGLQSEDEADYYCAAWDDSLNGYVFGTGTKLTVL (SEQ ID NO: 793)

VL AIRMTQSPSTLSASVGDRVTITCRASENIRNLLAWYQQKPGKAPELLIHGASTLGTGVPSRFSGGGSGTEFT
LTISSLQPDDFATYYCQQYESYFNTFGQGTKVEIK (SEQ ID NO: 794)

Group L

VH QVQLVESGPGVKKPGSSLKLSCTVSGFTFSSYDYYMHWVRQAPGNGLEWMAVIWYSGSNTYYNDSLKSRFSI
TRDNSKNTAYMQLNSLRAEDTAVYYCARAYFGVDVWGQGTLVTVSS (SEQ ID NO: 795)

VL DIVMTQSPASLSVSVGDRATISCRASQGIGNTLAWYQQKPGQAPKRLLIYRASQGIGNTLAGVPARFSGDGD
GTDFTLTIDDLEEPEDFATYYCQQYDHVPLTFGQGTKLEIK (SEQ ID NO: 796)

Group M

VH EVQLVQSGAEVKKPGASVKVSCKAFGYTFTTYPIEWMRQAHGQGLEWIGNFHPYNDDTKYNEKFKGRVTMTV
DKSTTTVYMELSSLRSEDTAVYYCARENYGSHGGFVYWGQGTLVTVS (SEQ ID NO: 797)

VH EVQLVQSGAEVKKPGASVKVSCKAFGYTFTTYPIEWMRQAHGQGLEWIGNFHPYNDDTKYNEKFKGRVTMTR
DTSTSTVYMELSSLRSEDTAVYYCARENYGSHGGFVYWGQGTLVTVS (SEQ ID NO: 798)

VH EVQLVQSGAEVKKPGASVKVSCKAFGYTFTTYPIEWVRQAPGQGLEWMGNFHPYNDDTKYNEKFKGRVTMTR
DTSTSTVYMELSSLRSEDTAVYYCARENYGSHGGFVYWGQGTLVTVS (SEQ ID NO: 799)

VH EVQLVQSGAEVKKPGSSVKVSCKASGYTFTTYPIEWVRQAPGQGLEWMGNFHPYNDDTKYNEKFKGRVTITA
DKSTSTAYMELSSLRSEDTAVYYCARENYGSHGGFVYWGQGTLVTVS (SEQ ID NO: 800)

VH EVQLVQSGAEVKKPGSSVKVSCKAFGYTFTTYPIEWMRQAHGQGLEWIGNFHPYNDDTKYNEKFKGRVTITV
DKSTTTVYMELSSLRSEDTAVYYCARENYGSHGGFVYWGQGTLVTVS (SEQ ID NO: 801)

VH EVQLVQSGAEVKKPGSSVKVSCKAFGYTFTTYPIEWMRQAHGQGLEWIGNFHPYNDDTKYNEKFKGRVTITA
DKSTSTAYMELSSLRSEDTAVYYCARENYGSHGGFVYWGQGTLVTVS (SEQ ID NO: 802)

TABLE 7-continued

Variable Heavy Chain Region (VH) and Variable Light Chain Region
(VL) Sequences for Activatable Antibodies that Bind PD-1

VL ENVLTQSPFSLSASVGDRVTITCRASSSVISSYLHWYQQKPAKAPKLWIYSTSNLASGVPDRFSGSGSGTSY
TLTISSLQPEDFATYYCQQYNGYPLTFGGGTKVEIK (SEQ ID NO: 803)

VL ENVLTQSPFSLSASVGDRVTITCRASSSVISSYLHWYQQKPAKAPKLFIYSTSNLASGVPSRFSGSGSGTDY
TLTISSLQPEDFATYYCQQYNGYPLTFGGGTKVEIK (SEQ ID NO: 804)

VL ENVLTQSPFSLSASVGDRVTITCRASSSVISSYLHWYQQKPAKAPKLWIYSTSNLASGVPDRFSGSGSGTSY
TLTISSLQPEDFATYYCQQYNSYPLTFGGGTKVEIK (SEQ ID NO: 805)

VL ENVMTQSPFSLSASVGDRVTITCRASSSVISSYLHWYQQKPAKAPKLFIYSTSNLASGVPSRFSGSGSGTDY
TLTISSLQPEDFATYYCQQYNGYPLTFGGGTKVEIK (SEQ ID NO: 806)

VL ENVMTQSPFSLSASVGDRVTITCRASSSVISSYLHWYQQKPAKAPKLFIYSTSNLASGVPSRFSGSGSGTDY
TLTISSLQPEDFATYYCQQYNSYPLTFGGGTKVEIK (SEQ ID NO: 807)

VL ENVLTQSPFSLSASVGDRVTITCRASSSVISSYLHWYQQKPAKAPKLFIYSTSNLASGVPSRFSGSGSGTDY
TLTISSLQPEDFATYYCQQYNSYPLTFGGGTKVEIK (SEQ ID NO: 808)

VL ENVLTQSPGTLSLSPGERATLSCRASSSVISSYLHWYQQKPGQAPRLWIYSTSNLASGVPDRFSGSGSGTSY
TLTISRLEPEDFATYYCQQYNGYPLTFGGGTKVEIK (SEQ ID NO: 809)

VL ENVLTQSPGTLSLSPGERATLSCRASSSVISSYLHWYQQKPGQAPRLWIYSTSNLASGVPDRFSGSGSGTSY
TLTISRLEPEDFATYYCQQYNSYPLTFGGGTKVEIK (SEQ ID NO: 810)

Group N

VH QVQLQQPGAELVKPGASVKLSCKASGYTFTSYYLYWMKQRPGQGLEWIGGVNPSNGGTNFSEKFKSKATLTV
DKSSSTAYMQLSSLTSEDSAVYYCTRRDSNYDGGFDYWGQGTTLTVSSAK (SEQ ID NO: 631)

VL DIVLTQSPTSLAVSLGQRATISCRASKSVSTSGFSYLHWYQQKPGQPPKLLIFLASNLESGVPARFSGSGSG
TDFTLNIHPVEEEDAATYYCQHSWELPLTFGAGTKLELK (SEQ ID NO: 635)

Group O

VH EVQLVESGGGLVQPGGSLRLSCAASGFTFSDYGMHWVRQAPGKGLEWVAYISSGSYTIYSADSVKGRFTISR
DNAKNTLYLQMSSLRAEDTAVYYCARRGYGSFYEYYFDYWGQGTTVTVS (SEQ ID NO: 1521)

VL QIVLTQSPATLSLSPGERATLSCSASSSVSYMYWYQQKPGQAPRLLIYLTSNRATGIPARFSGSGSGTDYTL
TISSLEPEDFAVYYCQQWSSNPFTFGQGTKLEIK (SEQ ID NO: 1522)

Group P

VH EVQLVQSGAEVKKPGESLRISCKGSGYTFTTYWMHWVRQATGQGLEWMGNIYPGTGGSNFDEKFKNRVTITA
DKSTSTAYMELSSLRSEDTAVYYCTRWTTGTGAYWGQGTTVTVSS (SEQ ID NO: 1523)

VH EVQLVQSGAEVKKPGESLRISCKGSGYTFTTYWMHWIRQSPSRGLEWLGNIYPGTGGSNFDEKFKNRFTISR
DNSKNTLYLQMNSLRAEDTAVYYCTRWTTGTGAYWGQGTTVTVSS (SEQ ID NO: 1524)

VH EVQLVQSGAEVKKPGESLRISCKGSGYTFTTYWMHWVRQAPGQGLEWMGNIYPGTGGSNFDEKFKNRFTISR
DNSKNTLYLQMNSLRAEDTAVYYCTRWTTGTGAYWGQGTTVTVSS (SEQ ID NO: 1525)

VL EIVLTQSPATLSLSPGERATLSCKSSQSLLDSGNQKNFLTWYQQKPGQAPRLLIYWASTRESGVPSRFSGSG
SGTEFTLTISSLQPDDFATYYCQNDYSYPYTFGQGTKVEIK (SEQ ID NO: 1526)

VL DIQMTQSPSSLSASVGDRVTITCKSSQSLLDSGNQKNFLTWYQQKPGQAPRLLIYWASTRESGIPPRFSGSG
YGTDFTLTINNIESEDAAYYFCQNDYSYPYTFGQGTKVEIK (SEQ ID NO: 1527)

VL EIVLTQSPATLSLSPGERATLSCKSSQSLLDSGNQKNFLTWYQQKPGKAPKLLIYWASTRESGVPSRFSGSG
SGTDFTFTISSLQPEDIATYYCQNDYSYPYTFGQGTKVEIK (SEQ ID NO: 1528)

VL DIVMTQTPLSLPVTPGEPASISCKSSQSLLDSGNQKNFLTWYQQKPGQAPRLLIYWASTRESGVPSRFSGSG
SGTDFTFTISSLEAEDAATYYCQNDYSYPYTFGQGTKVEIK (SEQ ID NO: 1529)

VL EIVLTQSPATLSLSPGERATLSCKSSQSLLDSGNQKNFLTWYQQKPGKAPKLLIYWASTRESGVPSRFSGSG
SGTDFTFTISSLEAEDAATYYCQNDYSYPYTFGQGTKVEIK (SEQ ID NO: 1530)

VL EIVLTQSPDFQSVTPKEKVTITCKSSQSLLDSGNQKNFLTWYQQKPGQAPRLLIYWASTRESGVPSRFSGSG
SGTDFTFTISSLEAEDAATYYCQNDYSYPYTFGQGTKVEIK (SEQ ID NO: 1531)

VL EIVLTQSPATLSLSPGERATLSCKSSQSLLDSGNQKNFLTWYQQKPGQAPRLLIYWASTRESGVPSRFSGSG
SGTDFTFTISSLEAEDAATYYCQNDYSYPYTFGQGTKVEIK (SEQ ID NO: 1532)

VL DIQMTQSPSSLSASVGDRVTITCKSSQSLLDSGNQKNFLTWYLQKPGQSPQLLIYWASTRESGVPSRFSGSG
SGTDFTFTISSLEAEDAATYYCQNDYSYPYTFGQGTKVEIK (SEQ ID NO: 1533)

VL DVVMTQSPLSLPVTLGQPASISCKSSQSLLDSGNQKNFLTWYQQKPGKAPKLLIYWASTRESGVPSRFSGSG
SGTDFTFTISSLEAEDAATYYCQNDYSYPYTFGQGTKVEIK (SEQ ID NO: 1534)

TABLE 7-continued

Variable Heavy Chain Region (VH) and Variable Light Chain Region
(VL) Sequences for Activatable Antibodies that Bind PD-1

HC EVQLVQSGAEVKKPGESLRISCKGSGYTFTTYWMHWVRQATGQGLEWMGNIYPGTGGSNFDEKFKNRVTITA
DKSTSTAYMELSSLRSEDTAVYYCTRWTTGTGAYWGQGTTVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLGK (SEQ ID NO: 1535)

HC QVQLVQSGAEVKKPGASVKVSCKASGYTFTTYWMHWIRQSPSRGLEWLGNIYPGTGGSNFDEKFKNRFTISR
DNSKNTLYLQMNSLRAEDTAVYYCTRWTTGTGAYWGQGTTVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLGK (SEQ ID NO: 1536)

HC EVQLVQSGAEVKKPGESLRISCKGSGYTFTTYWMHWIRQSPSRGLEWLGNIYPGTGGSNFDEKFKNRFTISR
DNSKNTLYLQMNSLRAEDTAVYYCTRWTTGTGAYWGQGTTVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLGK (SEQ ID NO: 1537)

HC EVQLVQSGAEVKKPGESLRISCKGSGYTFTTYWMHWVRQAPGQGLEWMGNIYPGTGGSNFDEKFKNRFTISR
DNSKNTLYLQMNSLRAEDTAVYYCTRWTTGTGAYWGQGTTVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLGK (SEQ ID NO: 1538)

HC EVQLVQSGAEVKKPGESLRISCKGSGYTFTTYWMHWVRQATGQGLEWMGNIYPGTGGSNFDEKFKNRVTITA
DKSTSTAYMELSSLRSEDTAVYYCTRWTTGTGAYWGQGTTVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLG (SEQ ID NO: 1539)

HC EVQLVQSGAEVKKPGESLRISCKGSGYTFTTYWMHWIRQSPSRGLEWLGNIYPGTGGSNFDEKFKNRFTISR
DNSKNTLYLQMNSLRAEDTAVYYCTRWTTGTGAYWGQGTTVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLG (SEQ ID NO: 1540)

LC EIVLTQSPATLSLSPGERATLSCKSSQSLLDSGNQKNFLTWYQQKPGQAPRLLIYWASTRESGVPSRFSGSG
SGTEFTLTISSLQPDDFATYYCQNDYSYPYTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTKSFN
RGEC (SEQ ID NO: 1541)

LC DIQMTQSPSSLSASVGDRVTITCKSSQSLLDSGNQKNFLTWYQQKPGQAPRLLIYWASTRESGIPPRFSGSG
YGTDFTLTINNIESEDAAYYFCQNDYSYPYTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTKSFN
RGEC (SEQ ID NO: 1542)

LC EIVLTQSPATLSLSPGERATLSCKSSQSLLDSGNQKNFLTWYQQKPGKAPKLLIYWASTRESGVPSRFSGSG
SGTDFTFTISSLQPEDIATYYCQNDYSYPYTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTKSFN
RGEC (SEQ ID NO: 1543)

LC DIVMTQTPLSLPVTPGEPASISCKSSQSLLDSGNQKNFLTWYQQKPGQAPRLLIYWASTRESGVPSRFSGSG
SGTDFTFTISSLEAEDAATYYCQNDYSYPYTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTKSFN
RGEC (SEQ ID NO: 1544)

LC EIVLTQSPATLSLSPGERATLSCKSSQSLLDSGNQKNFLTWYQQKPGKAPKLLIYWASTRESGVPSRFSGSG
SGTDFTFTISSLEAEDAATYYCQNDYSYPYTFGQGTKVEIKRTVAAPSVFIFPPSDEQLKSGTASVVCLLNN
FYPREAKVQWKVDNALQSGNSQESVTEQDSKDSTYSLSSTLTLSKADYEKHKVYACEVTHQGLSSPVTKSFN
RGEC (SEQ ID NO: 1545)

TABLE 7-continued

Variable Heavy Chain Region (VH) and Variable Light Chain Region
(VL) Sequences for Activatable Antibodies that Bind PD-1

LC EIVLTQSPDFQSVTPKEKVTITCKSSQSLLDSGNQKNFLTWYQQKPGQAPRLLIYWASTRESGVPSRFSGSG
   SGTDFTFTISSLEAEDAATYYCQNDYSYPYTFGQGTKVEIKRTVAAPSVFIFPPSDEQLKSGTASVVCLLNN
   FYPREAKVQWKVDNALQSGNSQESVTEQDSKDSTYSLSSTLTLSKADYEKHKVYACEVTHQGLSSPVTKSFN
   RGEC (SEQ ID NO: 1546)

LC DIQMTQSPSSLSASVGDRVTITCKSSQSLLDSGNQKNFLTWYLQKPGQSPQLLIYWASTRESGVPSRFSGSG
   SGTDFTFTISSLEAEDAATYYCQNDYSYPYTFGQGTKVEIKRTVAAPSVFIFPPSDEQLKSGTASVVCLLNN
   FYPREAKVQWKVDNALQSGNSQESVTEQDSKDSTYSLSSTLTLSKADYEKHKVYACEVTHQGLSSPVTKSFN
   RGEC (SEQ ID NO: 1547)

LC DVVMTQSPLSLPVTLGQPASISCKSSQSLLDSGNQKNFLTWYQQKPGKAPKLLIYWASTRESGVPSRFSGSG
   SGTDFTFTISSLEAEDAATYYCQNDYSYPYTFGQGTKVEIKRTVAAPSVFIFPPSDEQLKSGTASVVCLLNN
   FYPREAKVQWKVDNALQSGNSQESVTEQDSKDSTYSLSSTLTLSKADYEKHKVYACEVTHQGLSSPVTKSFN
   RGEC (SEQ ID NO: 1548)

LC EIVLTQSPATLSLSPGERATLSCKSSQSLLDSGNQKNFLTWYQQKPGQAPRLLIYWASTRESGVPSRFSGSG
   SGTDFTFTISSLEAEDAATYYCQNDYSYPYTFGQGTKVEIKRTVAAPSVFIFPPSDEQLKSGTASVVCLLNN
   FYPREAKVQWKVDNALQSGNSQESVTEQDSKDSTYSLSSTLTLSKADYEKHKVYACEVTHQGLSSPVTKSFN
   RGEC (SEQ ID NO: 1834)

Group Q

VH EVQLLESGGGLVQPGGSLRLSCSASGFTFSSYTMNWVRQAPGKGLEWVSGISDTGGNTYYTDSVKGRFTVSR
   DNSKNTLSLQMNSLRAEDTAVYYCAKDQGGSYPYYFHYWGQGSLVTVSS (SEQ ID NO: 1549)

VH EVQLVESGGGLVQPGGSLRLSCAASGFTVSNNYMSWVRQAPGKGLEWVSVIYSGGFTYYTDSVKGRFTISRH
   NSKNTLYLQMNSLRAEDTAVYYCARYYYDTSDYWTFFDYWGQGTLVTVSS (SEQ ID NO: 1550)

VH QVQLVESGGGVVQSGRSLRLSCAASGFTFSSYGMHWVRQAPGKGLEWVAVIWYDGSNIYYSDSVKGRFTISR
   ANSKNTLYLQMNSLRAEDTAVYYCARPGHWNYFFEYWGQGTLVTVSS (SEQ ID NO: 1551)

VH EVQLVESGGGLVQPGGSLRLSCGASGFTFRNYDMHWVRQITGKGLEWVSAIGSAGDTYYPDSVKGRFTISRE
   NAKNSLYLQMNSLRVGDTAVYYCTRDIHCSSTRCYGMDVWGQGTTVTVSS (SEQ ID NO: 1552)

VH EVQLVESGGGLVKPGGSLRLSCAASGFKFSNEWMSWVRQAPGKGLEWVGRIKSKTDGGTTDYAAPVKGRFTI
   SRDDSKNTLYLQMNSLKTEDTAVYYCTTDQDFWSGYYTGADYYGMDVWGQGTMVTVSS (SEQ ID
   NO: 1553)

VH QMQLQQWGAGLLKPSETLSLTCVVYGGSLNGYYWSWIRQSPGKGLEWIGEIDHSGSTNYNPSLKNRVTMSVD
   TSKIQFSLKLTSVTVADTAVYYCAREGLLPFDYWGQGTLVTVSS (SEQ ID NO: 1554)

VH QLQLQESGPDLVKPSDTLSLTCTVSDDSISSTTYYWAWIRQPPGKGLEWIGSMSYNGNNYYNPSLKSRVAIS
   AGTSQKQFSLKLTSVTAADTAVYHCARHLGYNGNWYPFDFWGQGILVTVSS (SEQ ID NO: 1555)

VH EVQVVESGGGLVEPGRSLRLSCKASGFTFDDYAMHWVRQTPGKALEWVSGINWSGNNIGYADSVKGRFTISK
   DDAKNSLYLQMNSLRPEDTALYYCTKDISITGTLDAFDVWGQGTMVTVSS (SEQ ID NO: 1556)

VH QVQLVESGGGVVQPGRSLRLSCAASGFTFSSYGMHWVRQAPGKGLEWVAIIWSDGDSEYNLDSVKGRFTISR
   DNSKNTLYLQMNSLRVEDSAVYYCARDRDLEDIWGQGTMVTSS (SEQ ID NO: 1557)

VH EVQLLESGGVLVQPGGSLRLSCAASGFTFSNFGMTWVRQAPGKGLEWVSGISGGGRDTYFADSVKGRFTISR
   DNSKNTLYLQMNSLKGEDTAVYYCVKWGNIYFDYWGQGTLVTVSS (SEQ ID NO: 1558)

VH EVQLVESGGGVVRPGGSLRLSCAASGFTFDDYGMSWVRQVPGKGLEWVSGISWNDGKTVYAESVKGRFIISR
   DNAKNSLYLEMNSLRAEDTALYYCARDWQYLIERYFDYWGQGTLVTVSS (SEQ ID NO: 1559)

VH EVQLVESGGGVVRPGGSLRLSCTASGFTFDDYGMSWVRQAPGKGLEWISGIGWTGGRSSYADSVRGRFTISR
   DNAKNSLYLQMNSLGAEDTALYYCARDRQWLVQWYFDYWGQGTLVTVSS (SEQ ID NO: 1560)

VH EVQLVESGGRVVRPGGSLRLSCAASGFTFDDYGMSWVRQLPGKGLEWVAGISWNDGKTVYAESVKGRFIISR
   DNAKNSLHLEMNSLRAEDTALYYCARDWQYLIDRYFDFWGQGTLVTVSS (SEQ ID NO: 1561)

VH EVQLVESGGGLVQPGGSLRLSCAASGFTFDDYAMHWVRQAPGKGLEWVSGIGWSSGSIGYADSVKGRFTISR
   DNAKNSLYLQMDSLRPEDSALYYCAKAYTFMITLYFDYWGQGTLVTVSS (SEQ ID NO: 1562)

VH EVQLVESGGGLVQPGRSLRLSCAASGFTFDDYDMHWVRQAPGKGLEWVSGSGWNRGSLGYADSVKGRFTISR
   DNAKKSLYLQMNSVRVEDTALYYCAKGFVVVSAAYFDYWGQGTLVTVSS (SEQ ID NO: 1563)

VH QVQLVQSGAEVKRPGSSVKVSCKVSGVTFRNFAIIWVRQAPGQGLEWMGGIIPFFSAANYAQSFQGRVTITP
   DESTSTAFMELASLRSEDTAVYYCAREGERGHTYGFDYWGQGTLVTVSS (SEQ ID NO: 1564)

VH EVQLVESGGGLVQSGRSLRLSCAASGFTFDDYAMHWVRQPPGKGLEWVSGINWNRGRTGYADSVKGRFTISR
   DNAKNSLYLQMNDLRVEDTALYYCAKAEQWLDEGYFDYWGQGTLVTVSS (SEQ ID NO: 1565)

VH EVQLVESGGGLVQRGGSLRLSCAASGFSFSSYAMNWVRQAPGKGLEWVSTISDSGGSTYYADSVKGRFTISR
   DNSKNTLSLQMNSLRAEDTAVYYCAKDQGGSYPYYFHYWGQGTLVTVSS (SEQ ID NO: 1566)

TABLE 7-continued

Variable Heavy Chain Region (VH) and Variable Light Chain Region (VL) Sequences for Activatable Antibodies that Bind PD-1

VH EVQLVESGGGLVQPGRSLRLSCAAS<u>GFTFEDYAM</u>HWVRQAPGKGLEWVSG<u>IGWSNVKI</u>GYADSVKGRFTISR
DNVRNSLYLQMNSLRTEDTAFYYC<u>VKAYTSMLTLYFDY</u>WGQGTLVTVSS (SEQ ID NO: 1567)

VH QVQLVQSGAEVKRPGASVKVSCKAS<u>GYTFTSFYM</u>YWVRQAPGQGLEWMGI<u>INPSDGST</u>SNAQKFQGRVTMTR
DTSTSTVYMELSSLRSEDTAVYYC<u>ARRVAGDIFDI</u>WGQGTMTVSS (SEQ ID NO: 1568)

VH QVQLQESGPGLVKPSETLSLTCTVS<u>GGSISSYH</u>WNWIRQSPGKGLEWIGY<u>IYYIGST</u>DYNPSLESRVTISVD
TSKNQFSLKLSSVTAADTAVYYC<u>ARVPVGATGASDV</u>WGQGTMVTVSS (SEQ ID NO: 1569)

VH EVQLVESGGSVVRPGGSLRLSCVVS<u>GFTFEDYGLS</u>WVRQIPGKGLEWVSG<u>ISWTGGNT</u>GYADSVKGRFTISR
DNAKNSLYLQMNSLRAEDTALYHC<u>TRDRQWLMQWYFDY</u>WGQGTLVTVSS (SEQ ID NO: 1570)

VH QVQLVESGGGVVQPGRSLRLSCSAS<u>GFTFSAYAM</u>HWVRQAPGKGLEWVAA<u>ISYGGSDK</u>YYADSVKGRFTISR
DNSKNTLYLQMNSLRTDDTAVYYC<u>AKSAHWNFFFDY</u>WGQGTLVTVSS (SEQ ID NO: 1571)

VH EVQLVESGGGLVQPGRSLRLSCVAS<u>GFALHDYAM</u>HWVRQVPGKGLEWVSS<u>ISWNSGVI</u>GYADSLKGRFTISR
DNAKNSLYLQMNSLRAEDTALYYC<u>AKGSGSYYVSWFDP</u>WGQGTLVTVSS (SEQ ID NO: 1572)

VH QLQLQESGPGLVQPSETLSLTCTVS<u>GDSISSTAYH</u>WDWIRQPPGKGLEWIGT<u>ITYNGNT</u>YFNPSLKSRVTIS
VDTSKNQFSLKLLSMTAAETAVFYC<u>ARHLGYNSDFFPFDF</u>WGQGTLVTVSS (SEQ ID NO: 1573)

VH EVQLVESGGGLVRPGGSLRLSCAAS<u>GFTFSTYAM</u>AWVRQTPGKGLEGVSA<u>IGGSGDST</u>YYVDSVKGRFTISR
DNSKSTLFLQMNSLRAEDTAVYYC<u>VKVRNYDGSFDI</u>WGQGTMVTVSS (SEQ ID NO: 1574)

VL DIQMTQSPSSLSASVGDRVTITCRAS<u>QSISSYL</u>IWYQQKPGTAPKFLIYAASSLQSGVPSRFSGCGSGTDFT
LTISSLQPEDFATYYC<u>QQSYSTPPIT</u>FGQGTRLEIK (SEQ ID NO: 1575)

VL EIVMTQSPATLSVSPGERATLSCRAS<u>QSVSSNL</u>AWYQQKPGQAPRLLIYGASTRATGIPARFSGSGSGTEFT
LTISSLQSGDFAVYYC<u>QQYNNWPLT</u>FGGGTKVEIN (SEQ ID NO: 1576)

VL EIVMTQSPATLSVSPGERATLSCRAS<u>QSVSSNL</u>AWYQQKPGQAPRLLIYGASTRATGIPARFSGSGSGTEFT
LTISSLQSGDFAVYYC<u>QQYNNWPLT</u>FGGGTKVEIN (SEQ ID NO: 1577)

VL DIQMTQSPSSLSASVGDRVTITCRAS<u>QSINNYL</u>NWYQQKPGKAPKLLIYTASSLQSGVPSRFSGSGSGTDFT
LTISSLQPEDFATYYC<u>QQSYSTPPLT</u>FGQGTQLEIK (SEQ ID NO: 1578)

VL DIQMTQSPSSLSASVGDRVTITCRAS<u>QSISNYL</u>NWYQQKPGKAPKLLIYAASSLQSGVPSRFSGSGSGTDFT
LTISSLQPEDFATYYC<u>QQSYSTPPIT</u>FGQGTRLEIK (SEQ ID NO: 1579)

VL DIQMTQSPSSLSASVGDRVTITCRAS<u>QSISSYL</u>NWYQQKPGKAPKLLIYAASSLQSGVPSRFSGSGSGTDFT
LTISSLQPEDFATYYC<u>QQSYSTPPIT</u>FGQGTRLEIK (SEQ ID NO: 1580)

VL EIVLTQSPGERVTLSLSPGERVTLSCRAS<u>QSVYSNYL</u>AWYQQNPGQAPRLLIYAASNRATGIPDRFSGSGSGTDF
TLTISRLEPEDFAVYYC<u>HQYATSPWT</u>FGQGTKVEIK (SEQ ID NO: 1581)

VL EIVLTQSPGTLSLSPGERATLSCRAS<u>QSVSSSYL</u>AWYQQKPGQAPRLLIYGASSRTTGIPDRFSGSGSGTDF
TLTISRLEPEDFAVYYC<u>QQYGSSPWT</u>FGQGTKVEIK (SEQ ID NO: 1582)

VL DIQMTQSPISVSASVGDRVTITCRAS<u>QGISNWL</u>AWYQQKPGIAPKLLIYSASSLQSGVPSRFRGSGSGTDFT
LTIGSLQPEDFATYYC<u>QQAHSFPLT</u>FGGGTKVEIK (SEQ ID NO: 1583)

VL DIQMTQSPSSLSASVGDRVTITCRAS<u>QGIRNDL</u>GWYQQKPGKAPKRLIYAASNLQSGVPSRFSGSGSGTEFT
LTISSLQPEDFATYYC<u>LQHNSYPLT</u>FGGGTKVEIK (SEQ ID NO: 1584)

VL DIQMTQSPSSLSASVGDSITITCRAS<u>LSINTFL</u>NWYQQKPGKAPNLLIYAASSLHGGVPSRFSGSGSGTDFT
LTIRTLQPEDFATYYC<u>QQSSNTPFT</u>FGPGTVVDFR (SEQ ID NO: 1585)

VL EIVLTQSPGTLSLSPGERATLSCRAS<u>QSVSSSY</u>LAWYQQKPGQAPRLLIYGASSRATGIPDRFSGSGSGTDF
TLTISRLEPEDFAVYYC<u>QQYGSSPWT</u>FGQGTKVEIK (SEQ ID NO: 1586)

VL DIQMTQSPSSLSASVGDRVTITCRAS<u>QSISSYL</u>NWYQQKPGKAPKLLIYAASSLQSGVPSRFSGSGSGTDFT
LTISSLQPEDFATYYC<u>QQSYSTPPIT</u>FGQGTRLEIK (SEQ ID NO: 1587)

HC EVQLLESGGVLVQPGGSLRLSCAAS<u>GFTFSNFGM</u>TWVRQAPGKGLEWVSG<u>ISGGGRDT</u>YFADSVKGRFTISR
DNSKNTLYLQMNSLKGEDTAVYYC<u>VKWGNIYFDY</u>WGQGTLVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLGK (SEQ ID NO: 1588)

HC EVQVVESGGGLVEPGRSLRLSCKAS<u>GFTFDDYAM</u>HWVRQTPGKALEWVSG<u>ISWSGNNI</u>GYADSVKGRFTISK
DDAKNSLYLQMNSLRPEDTALYYC<u>TKDISITGTLDAFDV</u>WGQGTMTVSSASTKGPSVFPLAPCSRSTSEST
AALGCLVKDYFPEPVTVSWNSGALTSGVHTFPAVLQSSGLYSLSSVVTVPSSSLGTKTYTCNVDHKPSNTKV
DKRVESKYGPPCPPCPAPEFLGGPSVFLFPPKPKDTLMISRTPEVTCVVVDVSQEDPEVQFNWYVDGVEVHN
AKTKPREEQFNSTYRVVSVLTVLHQDWLNGKEYKCKVSNKGLPSSIEKTISKAKGQPREPQVYTLPPSQEEM

TABLE 7-continued

Variable Heavy Chain Region (VH) and Variable Light Chain Region
(VL) Sequences for Activatable Antibodies that Bind PD-1

TKNQVSLTCLVKGFYPSDIAVEWESNGQPENNYKTTPPVLDSDGSFFLYSRLTVDKSRWQEGNVFSCSVMHE
ALHNHYTQKSLSLSLGK (SEQ ID NO: 1589)

HC EVQLVESGGGLVRPGGSLRLSCAAS<u>GFTFSTYA</u>MAWVRQTPGKGLEGVSA<u>IGGSGDST</u>YYVDSVKGRFTISR
DNSKSTLFLQMNSLRAEDTAVYYC<u>VKVRNYDGSFDI</u>WGQGTMVTSSASTKGPSVFPLAPCSRSTSESTAAL
GCLVKDYFPEPVTVSWNSGALTSGVHTFPAVLQSSGLYSLSSVVTVPSSSLGTKTYTCNVDHKPSNTKVDKR
VESKYGPPCPPCPAPEFLGGPSVFLFPPKPKDTLMISRTPEVTCVVVDVSQEDPEVQFNWYVDGVEVHNAKT
KPREEQFNSTYRVVSVLTVLHQDWLNGKEYKCKVSNKGLPSSIEKTISKAKGQPREPQVYTLPPSQEEMTKN
QVSLTCLVKGFYPSDIAVEWESNGQPENNYKTTPPVLDSDGSFFLYSRLTVDKSRWQEGNVFSCSVMHEALH
NHYTQKSLSLSLGK (SEQ ID NO: 1590)

HC QVQLVQSGAEVKRPGSSVKVSCKVS<u>GVTFRNFAI</u>IWVRQAPGQGLEWMGG<u>IIPFFSAAN</u>YAQSFQGRVTITP
DESTSTAFMELASLRSEDTAVYYC<u>AREGERGHTYGFDY</u>WGQGTLVTVSSASTKGPSVFPLAPCSRSTSESTA
ALGCLVKDYFPEPVTVSWNSGALTSGVHTFPAVLQSSGLYSLSSVVTVPSSSLGTKTYTCNVDHKPSNTKVD
KRVESKYGPPCPPCPAPEFLGGPSVFLFPPKPKDTLMISRTPEVTCVVVDVSQEDPEVQFNWYVDGVEVHNA
KTKPREEQFNSTYRVVSVLTVLHQDWLNGKEYKCKVSNKGLPSSIEKTISKAKGQPREPQVYTLPPSQEEMT
KNQVSLTCLVKGFYPSDIAVEWESNGQPENNYKTTPPVLDSDGSFFLYSRLTVDKSRWQEGNVFSCSVMHEA
LHNHYTQKSLSLSLGK (SEQ ID NO: 1591)

LC DIQMTQSPSSLSASVGDSITITCRAS<u>LSINTFL</u>NWYQQKPGKAPNLLIYAASSLHGGVPSRFSGSGSGTDFT
LTIRTLQPEDFATYYC<u>QQSSNTPFT</u>FGPGTVVDFRRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC
(SEQ ID NO: 1592)

LC DIQMTQSPISVSASVGDRVTITCRAS<u>QGISNW</u>LAWYQQKPGIAPKLLIYSASSLQSGVPSRFRGSGSGTDFT
LTIGSLQPEDFATYYC<u>QQAHSFPLT</u>FGGGTKVEIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC
(SEQ ID NO: 1593)

LC EIVLTQSPGTLSLSPGERATLSCRAS<u>QSVSSSY</u>LAWYQQKPGQAPRLLIYGASSRATGIPDRFSGSGSGTDF
TLTISRLEPEDFAVYYC<u>QQYGSSPWT</u>FGQGTKVEIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 1594)

LC DIQMTQSPSSLSASVGDRVTITCRAS<u>QSISSY</u>LNWYQQKPGKAPKLLIYAASSLQSGVPSRFSGSGSGTDFT
LTISSLQPEDFATYYC<u>QQSYSTPPIT</u>FGQGTRLEIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 1595)

Group R

VH EVKLVESGGGLVKPGGSLKLSCAASGFTFS<u>SYGMS</u>WLRQTPEKRLEWVA<u>TMSGGGRDIYYPDSMKG</u>RFTISR
DNAKNNLYLQMSSLRSEDTALYYCAR<u>QYYDDWFAY</u>WGQGTLVTVSA (SEQ ID NO: 1719)

VH QVQLKQSGPGLVQPSQNLSVTCTVSGFSLT<u>TYGVH</u>WVRQSPGKGLEWLG<u>VIWSGGSTDYNAAFIS</u>RLTISKD
NARSQVFFKMNSLQVNDTAMYYCAR<u>EKSVYGNYVGAMDY</u>WGQGTSVTVSS (SEQ ID NO: 1720)

VH EVKLVESGGGLVKPGGSLKLSCAASGFTFS<u>SYGMS</u>WVRQTPEKRLEWVA<u>TISGGGRDIYYPDSVKG</u>RLTISR
DNAKNNLYLQMSSLRSEDTALYYCVR<u>QYYDDWFAY</u>WGQGTLVTVSA (SEQ ID NO: 1721)

VH DVQLQESGPGLVKPSQSLSLTCTVTGYSIT<u>SDYAWN</u>WIRQFPGNQLEWMA<u>YISYSGYTSYNPSLKS</u>RISITR
DTSKNQFFLQLNSVTTEDTATYYCAR<u>SLDYDYGTMDY</u>WGQGTSVTVSS (SEQ ID NO: 1722)

VH EVKLVESGGGLVKPGGSLKLSCAASGFAFR<u>SYDMS</u>WVRQTPEKILEWVA<u>TISGGGSYTYYQDSVKG</u>RFTISR
DNARNTLYLQMSSLRSEDTALYYCAS<u>PYGPYFDY</u>WGQGTTLTVSS (SEQ ID NO: 1723)

VH DVQLQESGPGLVKPSQSLSLTCTVTGYSIT<u>SDYAWN</u>WIRQFPGNQLEWMA<u>YISYSGYTSYNPSLKS</u>RISITR
DTSRNQFFLQLNSVTTEDTATYYCAR<u>SLDYDYGTMDY</u>WGQGTSVTVSS (SEQ ID NO: 1724)

VH EVKLVESGGGLVKPGGSLKLSCSASGFSFS<u>YYDMS</u>WVRQTPEKGLEWVA<u>TISGGGRNTYFIDSVKG</u>RFTISR
DNVKNNLYLLMSSLRSEDTALYYCAS<u>PYEGAVDF</u>WGQGTSVTVSS (SEQ ID NO: 1725)

VH EVKLVESGGGLVKPGGSLKLSCAASGFTFS<u>SYGMS</u>WVRQTPEKRLEWVA<u>TISGGGRDTYYLDSVKG</u>RFTISRD
NAKNNLYLQMSSLRSEDTALYYCVR<u>QYYDDWFAY</u>WGQGTLVSNSA (SEQ ID NO: 1726)

VH QVQLQQSGDELVRPGTSVKMSCKAAGYTFT<u>NNWIG</u>WVKQRPGHGLEWIG<u>DFYPGGGYTNYNEKFKG</u>KATLTA
DTSSSTAYMQLSSLTSEDSAIYYCAR<u>GYGTNYWYFDV</u>WGAGTTVTVSS (SEQ ID NO: 1727)

VH QIHLVQSGPELKKPGETVKISCKASGYTFT<u>NFGMN</u>WVKQAPGKGLKWMG<u>WISGYTREPTYAADFKG</u>RFAISL
ETSASTAYLQINDLKNEDMATYFCAR<u>DVFDY</u>WGQGTTLTVSS (SEQ ID NO: 1728)

VH QIQLVQSGSELKKPGASVKVSCKASGYTFT<u>NFGMN</u>WVRQAPGQGLKWMG<u>WISGYTREPTYAADFKG</u>RFVISL
DTSVSTAYLQISSLKAEDTAVYYCAR<u>DVFDY</u>WGQGTLVTVSS (SEQ ID NO: 1729)

VH QVQLQESGPGLVKPSQTLSLTCTVSGYSIS<u>SDYAWN</u>WIRQPPGKGLEWMA<u>YISYSGYTSYNPSLKS</u>RITISR
DTSKNQFSLKLSSVTAADTAVYYCARS<u>LDYDYGTMDY</u>WGQGTLVTVSS (SEQ ID NO: 1730)

TABLE 7-continued

Variable Heavy Chain Region (VH) and Variable Light Chain Region
(VL) Sequences for Activatable Antibodies that Bind PD-1

VL DIVLTQTPATLSVTPGDSVSLSCRASQSISNNLHWYQQKSHESPRLLIKYASQSISGIPSRFSGSGSGTDFT
LNINSVETEDFGMYFCQQSNSWPLTFGAGTKLELKR (SEQ ID NO: 1731)

VL SIVMTQTPKFLLVSAGDRVTITCKASQSVSDDVAWYQQKPGQSPKLLIYYAFNRYTGVPDRFTGSGYGTDFT
FTISTVQSEDLAVYFCQQDYRSPWTFGGGTKLEIKR (SEQ ID NO: 1732)

VL DIVLTQSPATLSVTPGDSVSLSCRASQSISNDLHWYQQKSHESPRLLIKYVSQSISGIPSRFSGSGSGTDFT
LSINSVETEDFGMYFCQQSDSWPLTFGAGTKLELKR (SEQ ID NO: 1733)

VL QIVLSQSPAILSASPGEKVTMTCRANSSVSSMHWYQQKPGSSPEPWIYAISNLAFGVPTRFSGSGSGTSYSL
TISRVEAEDAATYFCQQWSSRPPTFGGGTKLEIKR (SEQ ID NO: 1734)

VL DIQMNQSPSSLSASLGDTITITCHASQSINVWLSWYQQKPGNIPKLLIYRASNLHTGVPSRFSGSGSGTGFT
LTISSLQPDDIATYYCQQGQSYPWTFGGGTKLEIKR (SEQ ID NO: 1735)

VL QIVLSQSPAILSASPGEKVTMTCRANSSVSSMHWYQQKPGSSPEPWIYAISNLAFGVPARFSGSGSGTSYSL
TISRVEAEDAATYFCQQWNSRPPTFGGGTKLEIKR (SEQ ID NO: 1736)

VL DIVMTQSHKVMSTSVGDRVSITCKASQDVDNAVAWYQQNPGQSPKLLIKWASTRHHGVPDRFTGSGSGTDFT
LTISTVQSEDLADFFCQQYSTFPYTFGGGTKLEIKR (SEQ ID NO: 1737)

VL DIVLTQTPATLSVTPGDSVSLSCRASQSLSNNLHWYQQKSHESPRLLIKYASQSISGIPSRFSGSGSGTDFT
LSINSVETEDFGMYFCQQSNSWPLTFGAGTKLEMKR (SEQ ID NO: 1738)

VL NIVMTQTPKILFISAGDRVTITCKASQSVSNDVAWYQQKPGQSPKLLIYYAFTRYIGVPDRFTGSGYGTDFT
FTISTVQAEDLAVYFCQQDYSSPYTFGGGTKLEIKR (SEQ ID NO: 1739)

VL DIVLTQSPASLAVSLGQRATISCRASESVDNYGYSFMNWFQQKPGQPPKLLIYRASNLESGIPARFSGSGSR
TNFTLTINPVEADDVATYFCQQSNADPTFGGGTNLEIKR (SEQ ID NO: 1740)

VL DIVLTQSPASLAVSPGQRATITCRASESVDNYGYSFMNWFQQKPGQPPKLLIYRASNLESGVPARFSGSGSR
TDFTLTINPVEANDTANYYCQQSNADPTFGQGTKLEIK (SEQ ID NO: 1741)

VL EIVLTQSPATLSLSPGERATLSCRANSSVSSMHWYQQKPGQSPEPWIYAISNLAFGVPARFSGSGSGTDYTL
TISSLEPEDFAVYYCQQWSSRPPTFGQGTKLEIK (SEQ ID NO: 1742)

Group S

VH QVQLVQSGSEVKKSGSSVKVSCKTSGGTFSITNYAINWVRQAPGQGLEWMGGILPIFGAAKYAQKFQDRVTI
TADESTNTAYLELSSLTSEDTAMYYCARGKRWLQSDLQYWGQGTLVTVSS (SEQ ID NO: 1743)

VL QPVLTQPASVSGSPGQSITISCTGSSSDVGSYDLVSWYQQSPGKVPKLLIYEGVKRPSGVSNRFSGSKSGNT
ASLTISGLQAEDEADYYCSSYAGTRNFVFGGGTQLTVL (SEQ ID NO: 1744)

Group T

VH QVQLVQSGAEVKKPGASVKVSCKASGYTFTNYYMYWVKQAPGQGLEWIGGINPSNGGTNYNEKFKNKATLTA
DKSTSTAYMELSSLRSEDTAVYYCTRRDYRYDMGFDYWGQGTTVTVSS (SEQ ID NO: 1745)

VH QVQLVQSGAEVKKPGASVKVSCKASGYTFTSYYMYWVRQAPGQGLEWMGGVNPSNGGTNFNEKFKSRVTITA
DKSTSTAYMELSSLRSEDTAVYYCARRDYRYDMGFDYWGQGTTVTVSS (SEQ ID NO: 1746)

VH EVQLQQSGPELVKPGASVKISCKASGYTFTNYYMYWVKQSHGKSLEWIGGINPSNGGTNYNEKFKNKATLTV
DKSSTAYMELNSLTSEDSAVYYCARRDYRYDMGFDYWGAGTTVTVSS (SEQ ID NO: 1747)

VH EVQLQQSGPVLVKPGASVKMSCKASGYTFTSYYMYWVKQSHGKSLEWIGGVNPSNGGTNFNEKFKSKATLTV
DKSSTAYMELNSLTSEDSAVYYCARRDYRYDMGFDYWGQGTTLTVSS (SEQ ID NO: 1748)

VL EIVLTQSPATLSLSPGERATISCRASKGVSTSGYSYLHWYQQKPGQAPRLLIYLASYLESGVPARFSGSGSG
TDFTLTISSLEPEDFATYYCQHSRELPLTFGTGTKVEIK (SEQ ID NO: 1749)

VL QIVLTQSPAIMSASPGEKVTMTCRASKGVSTSGYSYLHWYQQKPGSSPRLLIYLASYLESGVPVRFSGSGSG
TSYSLTISRMEAEDAATYYCQHSRELPLTFGTGTRLEIK (SEQ ID NO: 1750)

Group U

VH QVQLQQSGAELMKPGASVKMSCKTTGYIFSSYWIGWVKQRPGHGLEWIGKIFPGSGSADYNENFKGKATFTV
DTSSNTAYMQLSSLTSEDSAVYYCARGYGNYLYFDVWGAGTTVTVSS (SEQ ID NO: 619)

VH DVQLQESGPGLVKPSQSLSLTCTVTGHSITSDYAWNWIRQFPGNKLEWMGYISYSGRTSYNPSLTSRISITR
DTSKNQFFLQLNSVTTEDTATYYCARGYALDYWGQGTSVTVSS (SEQ ID NO: 1835)

VH EVKLVESGGGLVSPGGSLKLSCAASGFTFSTFGMSWVRQTPEKRLEWVATISGGGSDTYYPDSVQGRFIISR
YNAKNNLYLQMNSLRPEDTALYYCARQGYDVYSWFAYWGQGTLVTVSA (SEQ ID NO: 1836)

VH EVKLVESGGGLVKPGGSLKLSCAASGFTFSTYGMSWVRQTPEKRLQWVATISGGGSNTYYSDSVKGRFTISR
DNAKNNLYLQMSSLRSEDTALYYCARQRDSAWFASWGQGTLVTVSA (SEQ ID NO: 1837)

TABLE 7-continued

Variable Heavy Chain Region (VH) and Variable Light Chain Region
(VL) Sequences for Activatable Antibodies that Bind PD-1

VH EVQLVESGGGLVKPGGSLRLSCAASGFTFSTFGMSWVRQAPGKGLEWVSTISGGGSDTYYPDSVQGRFTISR
DNAKNSLYLQMNSLRAEDTAVYYCARQGYDVYSWFAYWGQGTLVTVSS (SEQ ID NO: 1838)

VH EVQLVESGGGLVQPGGSLRLSCAASGFTFSTFGMSWVRQAPGKGLEWVATISGGGSDTYYPDSVQGRFTISR
DNAKNSLYLQMNSLRAEDTAVYYCARQGYDVYSWFAYWGQGTLVTVSS (SEQ ID NO: 1839)

VH EVQLVESGGGLVKPGGSLRLSCAASGFTFSTYGMSWVRQAPGKGLEWVATISGGGSNTYYSDSVKGRFTISR
DDSKNTLYLQMNSLKTEDTAVYYCARQRDSAWFASWGQGTLVTVSS (SEQ ID NO: 1840)

VH EVQLVQSGAEVKKPGASVKVSCKASGYRFPHYGISWVRQAPGQGLEWMGWISAYNGNTNYAQKLQGRVTMTT
DTSTNTAYMELRSLRSDDTAVYYCARDVDYGTGSGYWGQGTLVTVSS (SEQ ID NO: 1841)

VH EVQLVQSGAEVKKPGASVKVSCKASGYRFTRQGISWVRQAPGQGLEWMGWISAYNGNTKYAQKLQGRVTMTT
DTSTNTAYMELRSLRSDDTAVYYCARDVDYGSGSGYWGQGTLVTVSS (SEQ ID NO: 1842)

VH EVQLVQSGAEVKKPGASVKVSCKASGYRFSTFGISWVRQAPGQGLEWMGWISAYNGNTNYAQKLQGRVTMTT
DTSTNTAYMELRSLRSDDTAVYYCARDVDYSSGSGYWGQGTLVTVSS (SEQ ID NO: 1843)

VH EVQLVQSGAEVKKPGASVKVSCKASGYRFTRYGISWVRQAPGQGLEWMGWVSAHNGNTNYAQKLQGRVTMTT
DTSTNTAYMELRSLRSDDTAVYYCARDADYGSGSGYWGQGTLVTVSS (SEQ ID NO: 1844)

VH EVQLVQSGAEVKKPGASVKVSCKASGYRFPHYGISWVRQAPGQGLEWMGWISAYNGNTNYAQKLQGRVTMTT
DTSTNTAYMELRSLRSDDTAVYYCARDAEYGSGSGYWGQGTLVTVSS (SEQ ID NO: 1845)

VH EVQLVQSGAEVKKPGASVKVSCKASGYRFTWYGISWVRQAPGQGLEWMGWISAYNGNTNYAQKLQGRVTMTT
DTSTNTAYMELRSLRSDDTAVYYCARDSEYSSGSGYWGQGTLVTVSS (SEQ ID NO: 1846)

VH EVQLVQSGAEVKKPGASVKVSCKASGYRFETYGISWVRQAPGQGLEWMGWISAYNGNTNYAQKLQGRVTMTT
DTSTNTAYMELRSLRSDDTAVYYCARDAEYSLGSGYWGQGTLVTVSS (SEQ ID NO: 1847)

VH EVQLVQSGAEVKKPGASVKVSCKASGYRFRQYGISWVRQAPGQGLEWMGWISAYNGNTNYAQKLQGRVTMTT
DTSTNTAYMELRSLRSDDTAVYYCARDAEYGSGSGYWGQGTLVTVSS (SEQ ID NO: 1848)

VH EVQLVQSGAEVKKPGASVKVSCKASGYRFTWYGISWVRQAPGQGLEWMGWISAYNGNTNYAQKLQGRVTMTT
DTSTNTAYMELRSLRSDDTAVYYCARDSEYRSGSGYWGQGTLVTVSS (SEQ ID NO: 1849)

VH EVQLVQSGAEVKKPGASVKVSCKASGYRFRQYGISWVRQAPGQGLEWMGWISAYNGNTNYAQKLQGRVTMTT
DTSTNTAYMELRSLRSDDTAVYYCARDAEYRSGSGYWGQGTLVTVSS (SEQ ID NO: 1850)

VH EVQLVQSGAEVKKPGASVKVSCKASGYRFTRYGISWVRQAPGQGLEWMGWVSAHNGNTNYAQKLQGRVTMTT
DTSTNTAYMELRSLRSDDTAVYYCARDADYRSGSGYWGQGTLVTVSSS (SEQ ID NO: 1851)

VH EVQLVQSGAEVKKPGASVKVSCKASGYRFPHYGISWVRQAPGQGLEWMGWISAYNGNTNYAQKLQGRVTMTT
DTSTNTAYMELRSLRSDDTAVYYCARDVDYRTGSGYWGQGTLVTVSS (SEQ ID NO: 1852)

VH EVQLVQSGAEVKKPGASVKVSCKASGYRFSTFGISWVRQAPGQGLEWMGWISAYNGNTNYAQKLQGRVTMTT
DTSTNTAYMELRSLRSDDTAVYYCARDVDYRSGSGYWGQGTLVTVSS (SEQ ID NO: 1853)

VH EVQLVQSGAEVKKPGASVKVSCKASGYRFTRQGISWVRQAPGQGLEWMGWISAYNGNTKYAQKLQGRVTMTT
DTSTNTAYMELRSLRSDDTAVYYCARDVDYRSGSGYWGQGTLVTVSS (SEQ ID NO: 1854)

VH EVQLVQSGAEVKKPGASVKVSCKASGYRFPHYGISWVRQAPGQGLEWMGWISAYNGNTNYAQKLQGRVTMTT
DTSTNTAYMELRSLRSDDTAVYYCARDAEYRSGSGYWGQGTLVTVSS (SEQ ID NO: 1855)

VH EVQLVQSGAEVKKPGASVKVSCKASGYRFETYGISWVRQAPGQGLEWMGWISAYNGNTNYAQKLQGRVTMTT
DTSTNTAYMELRSLRSDDTAVYYCARDAEYRLGSGYWGQGTLVTVSS (SEQ ID NO: 1869)

VL NIVMTQTPKFLLVSAGDRITITCKASQSVSDDVAWYQQKPGQSPKLLISYAFKRYIGVPDRFTGSGYGTDFT
FTISTVQAEDLAVYFCQQNYNSPYTFGGGTKLELKR (SEQ ID NO: 1856)

VL QIVLSQSPAILSASPGEKVTMTCRTSSSVNYMHWFQQKPGSSPKPWIYATSKLASGVPARFSGSGSGTSYSL
TISRVEAEDAATYFCQQWISDPWTFGGGTKLEIK (SEQ ID NO: 1857)

VL SYELTQPPSVSVSPGQTARITCSGDALTTQYAYWYQQKPGQAPVMVIYKDTERPSGIPERFSGSSSGTKVTL
TISGVQAEDEADYYCQSADNSITYRVFGGGTKVTVL (SEQ ID NO: 1858)

VL SYELTQPPSVSVSPGQTARITCSGDALSEQYAYWYQQKPGQAPVMVIYKDTERPSGIPERFSGSSSGTKVTL
TISGVQAEDEADYYCQSADNSITYRVFGGGTKVTVL (SEQ ID NO: 1859)

VL SYELTQPPSVSVSPGQTARITCSGDALPKQYAYWYQQKPGQAPVMVIYKDTERPSGIPERFSGSSSGTKVTL
TISGVQAEDEADYYCQSADNSITYRVFGGGTKVTVL (SEQ ID NO: 737)

VL SYELTQPPSVSVSPGQTARITCSGDALPMQYGYWYQQKPGQAPVMVLYKDTERPSGIPERFSGSSSGTKVTL
TISGVQAEDEDYYCQSDNSITYRVFGGGTKVTVL (SEQ ID NO: 1860)

TABLE 7-continued

Variable Heavy Chain Region (VH) and Variable Light Chain Region
(VL) Sequences for Activatable Antibodies that Bind PD-1

VL SYELTQPPSVSVSPGQTARITC<u>SGDALPMQYGYW</u>YQQKPGQAPVMVIY<u>KDTERPS</u>GIPERFSGSSSGTKVTL
TISGVQAEDEADYYC<u>QSADNSITYRV</u>FGGGTKVTVL (SEQ ID NO: 1861)

VL DIILTQSPASLAVSLGQRAAISCRASESVDNSGISFMSWFQQKPGQPPKLLIYTASNQGSGVPARFSGSGSG
TEFSLNIHPMEEDDTAMYFCQQSKEVPWTFGGGTKLEIR (SEQ ID NO: 1862)

VL DIVLTQSPASLAVSLGQRATISCRASENVDDYGVSFMNWFQQKPGQPPKLLIYPASNQGSGVPARFSGSGSG
TDFSLNIHPMEEDDTAMYFCQQSKEVPWTFGGGTKLEIK (SEQ ID NO: 1863)

VL DIQLTQSPSFLSASVGDRVTITCRASESVDNSGISFMSWYQQKPGKAPKLLIYTASNQGSGVPSRFSGSGSG
TEFTLTISSLQPEDFATYYCQQSKEVPWTFGQGTKVEIK (SEQ ID NO: 1864)

VL EIVLTQSPATLSLSPGERATLSCRASESVDNSGISFMSWYQQKPGQAPRLLIYTASNQGSGIPARFSGSGSG
TDFTLTISSLEPEDFAVYYCQQSKEVPWTFGQGTKVEIK (SEQ ID NO: 1865)

VL EIVLTQSPATLSLSPGERATLSCRASENVDDYGVSFMNWYQQKPGQAPRLLIYPASNQGSGIPARFSGSGSG
TDFTLTISSLEPEDFAVYYCQQSKEVPWTFGQGTKVEIK (SEQ ID NO: 1866)

VL EIVLTQSPGTLSLSPGERATLSCRASENVDDYGVSFMNWYQQKPGQAPRLLIYPASNQGSGIPDRFSGSGSG
TDFTLTISRLEPEDFAVYYCQQSKEVPWTFGQGTKVEIK (SEQ ID NO: 1867)

VL DIVMTQSPDSLAVSLGERATINCRASENVDDYGVSFMNWYQQKPGQPPKLLIYPASNQGSGVPDRFSGSGSG
TDFTLTISSLQAEDVAVYYCQQSKEVPWTFGGGTKLEIK (SEQ ID NO: 1868)

Group V

VH QVQLVQSGAEVKKPGASVKVSCKAS<u>GYTFTSYWIN</u>WVRQAPGQGLEWMG<u>NIYPGSSLTNYNEKFKN</u>RVTMTR
DTSTSTVYMELSSLRSEDTAVYYCAR<u>LLTGTFAY</u>WGQGTLVTVSS (SEQ ID NO: 1870)

VH QVQLVQSGAEVKKPGASVKVSCKAS<u>GYTFTSYWIN</u>WVRQAPGQGLEWMG<u>NIYPGSSLTNYNEKFKN</u>RVTMTR
DTSTSTVYMELSSLRSEDTAVYYCAR<u>LSTGTFAY</u>WGQGTLVTVSS (SEQ ID NO: 1871)

VH QVQLVQSGAEVKKPGASVKVSCKAS<u>GYTFTSYWIN</u>WVRQAPGQGLEWMG<u>NIYPGSSITNYNEKFKN</u>RVTMTR
DTSTSTVYMELSSLRSEDTAVYYCAR<u>LTTGTFAY</u>WGQGTLVTVSS (SEQ ID NO: 1872)

VH QVQLVQSGAEVKKPGASVKVSCKAS<u>GYTFTSYWIN</u>WVRQAPGQGLEWMG<u>NIWPGSSLTNYNEKFKN</u>RVTMTR
DTSTSTVYMELSSLRSEDTAVYYCAR<u>LLTGTFAY</u>WGQGTLVTVSS (SEQ ID NO: 1873)

VH DIVMTQSPDSLAVSLGERATINC<u>KSSQSLWDSGNQKNFLT</u>WYQQKPGQPPKLLIY<u>WTSTRES</u>GVPDRFSGSG
SGTDFTLTISSLQAEDVAVYYC<u>QNDYFYPLT</u>FGGGTKVEIK (SEQ ID NO: 1874)

VL DIVMTQSPDSLAVSLGERATINC<u>KSSQSLWDSGNQKNFLT</u>WYQQKPGQPPKLLIY<u>WTSYRES</u>GVPDRFSGSG
SGTDFTLTISSLQAEDVAVYYC<u>QNDYFYPLT</u>FGGGTKVEIK (SEQ ID NO: 1875)

VL DIVMTQSPDSLAVSLGERATINC<u>KSSQSLWDSGNQKNFLT</u>WYQQKPGQPPKLLIY<u>WTSYRES</u>GVPDRFSGSG
SGTDFTLTISSLQAEDVAVYYC<u>QNDYFYPHT</u>FGGGTKVEIK (SEQ ID NO: 1876)

VL DIVMTQSPDSLAVSLGERATINC<u>KSSQSLWDSTNQKNFLT</u>WYQQKPGQPPKLLIY<u>WTSTRES</u>GVPDRFSGSG
SGTDFTLTISSLQAEDVAVYYC<u>QNDYFYPLT</u>FGGGTKVEIK (SEQ ID NO: 1877)

HC QVQLVQSGAEVKKPGASVKVSCKASGYTFTSYWINWVRQAPGQGLEWMGNIYPGSSLTNYNEKFKNRVTMTR
DTSTSTVYMELSSLRSEDTAVYYCAR<u>LSTGTFAY</u>WGQGTLVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLGK (SEQ ID NO: 1878)

HC QVQLVQSGAEVKKPGASVKVSCKAS<u>GYTFTSYWIN</u>WVRQAPGQGLEWMG<u>NIYPGSSLTNYNEKFKN</u>RVTMTR
DTSTSTVYMELSSLRSEDTAVYYCAR<u>LSTGTFAY</u>WGQGTLVTVSSASTKGPSVFPLAPCSRSTSESTAALGC
LVKDYFPEPVTVSWNSGALTSGVHTFPAVLQSSGLYSLSSVVTVPSSSLGTKTYTCNVDHKPSNTKVDKRVE
SKYGPPCPPCPAPEFLGGPSVFLFPPKPKDTLMISRTPEVTCVVVDVSQEDPEVQFNWYVDGVEVHNAKTKP
REEQFNSTYRVVSVLTVLHQDWLNGKEYKCKVSNKGLPSSIEKTISKAKGQPREPQVYTLPPSQEEMTKNQV
SLTCLVKGFYPSDIAVEWESNGQPENNYKTTPPVLDSDGSFFLYSRLTVDKSRWQEGNVFSCSVMHEALHNH
YTQKSLSLSLG (SEQ ID NO: 1879)

LC DIVMTQSPDSLAVSLGERATINC<u>KSSQSLWDSGNQKNFLT</u>WYQQKPGQPPKLLIY<u>WTSYRES</u>GVPDRFSGSG
SGTDFTLTISSLQAEDVAVYYC<u>QNDYFYPHT</u>FGGGTKVEIKRGTVAAPSVFIFPPSDEQLKSGTASVVCLLN
NFYPREAKVQWKVDNALQSGNSQESVTEQDSKDSTYSLSSTLTLSKADYEKHKVYACEVTHQGLSSPVTKSF
NRGEC (SEQ ID NO: 1880)

Group W

VH EVQLQESGPELVRPGASVKMSCKASGYTFTSYWMHWVKQRPGQGLEWIGMIDPSNSETSLNQKFKDKATLNV
DKSTNTAYMQLSSLTSEDSAVYYCARSRGNYAYEMDYWGQGTSVTVSS (SEQ ID NO: 1972)

TABLE 7-continued

Variable Heavy Chain Region (VH) and Variable Light Chain Region
(VL) Sequences for Activatable Antibodies that Bind PD-1

VH EVQLQESGPELVRPGASVKMSCKASGYTFTSYWMHWVKQRPGQGLEWIGMIEPSSSETSLNQKFKDKATLNV
DKSSNTAYMQLSSLTSEDSAVYYCARSRGNYAYEMDYWGQGTSVTVSS (SEQ ID NO: 1973)

VH EVQLQESGPELVRPGASVKMSCKASGYTFTSYWMHWVKQRPGQGLEWIGMIDPYSSETSLNQKFKDKATLNV
DKISNTAYMQLSSLTSEDSAVYFCARSRGNYAYDMDYWGQGTSVTVSS (SEQ ID NO: 1974)

VH EVQLQESGPELVRPGASVKMSCKASGYTFTSYWMHWVKQRPGQGLEWIGMIDPSNSETSLNQKFKDKATLNV
DKSSKTAYMQLSSLTSEDSAVYYCARSRGNYAYDMDYWGQGTSVTVSS (SEQ ID NO: 1975)

VH EVQLQESGAELVMPGASVKMSCKASGYTFTDYWMHWVKQRPGQGLEWIGAIDTSDSYTSYHQNFKGKATLTE
DESSSTAYMQLSSLTSEDSAIYYCARRDYGGFGYWGQGTTLTVSS (SEQ ID NO: 1976)

VH EVQLQESGPELVKPGASVKIPCKASGYTFTDYNMDWVKKSHGKSLEWIGDIDPNNGGTIYNQKFKGKATLTV
DKSSRTAYMELRSLTSEDTAVYYCARWRSSMDYWGQGTSVTVSS (SEQ ID NO: 1977)

VH EVQLQESGPELVKPGASVKIPCRASGYIFTDYNMDWVKQSHGKSLEWIGDIDPNNGGTIYNQKFKDKTTLTV
DKSSRTAYMELRSLTSEDTAVYYCARWRSSMDYWGQGTSVTVSS (SEQ ID NO: 1978)

VH EVQLQESGPELVKPGASVKIPCKASGYTFTDYNMDWVKQNHGKSLEWIGDIDPNNGDTIYNQKFKGKATLTV
DKSSRTAYMELRSLTSEDTAVYYCARWRSSMDYWGQGTSVTVSS (SEQ ID NO: 1979)

VH EVQLQESGPELVKPGASVKIPCKASGYTFTDYNMDWVKQSHGKSLEWIGDIDPNSGGSIYNQKFKGKATLTV
DKSSRTVYMELRSLTSEDTAVYYCARWRSSMDYWGQGTSVTVSS (SEQ ID NO: 1980)

VH EVQLQESGPELVKPGASVKITCKASGYTFTDYNMDWVKQSHGKSLEWIGDIDPNNGGTIYNQKFKGKATLTV
DKSSNTAYMELRSLASEDTAVYYCARWRSSMDYWGQGTSVSVSS (SEQ ID NO: 1981)

VH EVQLQESGPELVKPGASVKIPCKASGYTFTDYNMDWVKQSHGKSLEWIGDIDPNNGGTIYNQNFKGKATLTV
DKSSSTAYMELRSLTSEDTAVYYCARWRSSMDYWGQGTSVTVSS (SEQ ID NO: 1982)

VH EVQLQESGPELVKPGASVKIPCKASGYTFTDYNMDWVKQSHGKSLEWIGDIDPNNGGIIYNQKFKGKAALTV
DKSSSTAYMELRSLTSEDTAVYYCARWRSSMDYWGQGTSVTVSS (SEQ ID NO: 1983)

VH EVQLQESGPELVKPGASVKIPCKASGYTFTDYNMDWVKQSHGKSLEWIGDIDPNNGGIIYNQKFKGKAALTV
DKSSSTAYMELRSLTSEDTAVYYCTRWRSSMDYWGQGTSVTVSS (SEQ ID NO: 1984)

VH EVQLQESGPELVKPGASVKIPCKASGYTFTDYNMDWVKQSHGKSLEWIGDIDPNNGNTIYNQKFKGKATLTV
DKSSSTAYMELRSLTSEDTAVYYCTKWRSSMDYWGQGTSVTVSS (SEQ ID NO: 1985)

VH EVQLQESGPELVRPGASVKIPCKASGYTFTDYNMDWVMQSHGKSLEWIGDIDPNNGGTIYNQKFKGKATLTV
DKSSSTAYMELRSLTSEDTAVYYCTRWRSSMDYWGQGTSVTVSS (SEQ ID NO: 1986)

VH EVQLQESGPELVKPGASVKIPCKASGYTFTDYNVDWVKQSHGKSLEWIGDIDPNNGGTFYNQKFKGKATLTV
DKSSSTAHMELRSLTSEDTAVYYCVRWRSSMDYWGQGTSVTVSS (SEQ ID NO: 1987)

VH EVQLQESGPELVKPGASVKIPCKASGYTFTDYNMDWVKQSHGKSLEWIGDIDPNTGTTFYNQDFKGKATLTV
DKSSSTAYMELRSLTSEDTAVYYCARWRSSMDYWGQGTSLTVSS (SEQ ID NO: 1988)

VH EVQLQESGAELVRPGASVTLSCKASGYTFTDYEMHWVKQTPVHGLEWIGVIDPGTGGTAYNQKFKVKALLTA
DKSSNTAYMELRSLTSEDSAVYYCTSEKFGSNYYFDYWGQGTTLTVSS (SEQ ID NO: 1989)

VH EVQLQESGAELVRPGASVTLSCKASGYTFTDYEIHWVKQTPVHGLEWIGAIDPETGGTAYNQKFKGKAILTA
DKSSSTAYMELRSLTSEDSAVYYCTSEKFGSSYYFDYWGQGTTFTVSS (SEQ ID NO: 1990)

VH EVQLQESGPGLVKPSQSLSLTCTVTGYSITSDYAWNWIRQFPGNKLEWMGYITYSGSPTYNPSLKSQFSITR
DTSKNQFFLQLNSLTTEDTATYYCARGLGGHYFDYWGQGTTLTVSS (SEQ ID NO: 1991)

VH EVQLQESGPGLVKPSQSLSLTCTVTGYSITSDYAWNWIRQFPGNKLEWMGYITYSGSPTYNPSLKSQFSITR
DTSKNQFFLQLNSVTTEDTATYYCARGLGGHYFDYWGQGTTLTVSS (SEQ ID NO: 1992)

VH EVQLQESGPDLVKPSQSLSLTCTVTGYSITSGYSWHWIRQFPGNKLEWMGFIHYSGDTNYNPSLKSRFSITR
DTSKNQFFLHLNSVTPEDTATYYCASPSRLLFDYWGHGTTLTVSS (SEQ ID NO: 1993)

VH EVQLQESGPGLVAPSQSLSITCTVSGFSLTNYGVDWVRQSPGKGLEWLGVIWGVGSTNYNSALKSRLSISKD
NSKSQVFLKMNSLQTDDTAMYYCASDGFVYWGQGTLVTVSS (SEQ ID NO: 1994)

VH EVQLQESGPGLVAPSQSLSITCTVSGFSLTSYGVDWVRQSPGKGLEWLGVIWGIGSTNYNSALKSRLSISKD
NSKSQVFLKMNSLQSDDTAMYYCASDGFVYWGQGTLVTVSS (SEQ ID NO: 1995)

VH EVQLQESGPSLVQPSQSLSITCTVSGFSLTSYGVHWVRQSPGKGLEWLGVIWRGGNTDYNAAFMSRLSITKD
NSKSQVFFKMNSLQADDTAIYYCAASMIGGYWGQGTTLTVSS (SEQ ID NO: 1996)

VH EVQLQESGPSLVQPSQSLSITCTVSGFSLTNYGVHWVRQSPGKGLEWLGVIWRGGNTDYNAAFMSRLSITKD
NSKSQVFFKFHSLQTDDTAIYYCAASMIGGYWGQGTTLTVSS (SEQ ID NO: 1997)

VH QVQLVQSGAEVKKPGASVKVSCKASGYTFTSYWMHWVRQAPGQGLEWMGMIDPSNSETSLNQKFQGRVTMTV
DKSTNTVYMELSSLRSEDTAVYYCARSRGNYAYEMDYWGQGTLVTVSS (SEQ ID NO: 1998)

TABLE 7-continued

Variable Heavy Chain Region (VH) and Variable Light Chain Region (VL) Sequences for Activatable Antibodies that Bind PD-1

VH EVQLVQSGAEVKKPGASVKVSCKASGYTFTSYWMHWVRQAPGQGLEWMGMIDPSNSETSLNQKFQGRVTLNV
DKSTNTAYMELSSLRSEDTAVYYCARSRGNYAYEMDYWGQGTLVTVSS (SEQ ID NO: 1999)

VH EVQLVQSGTEVTKPGASVKVSCKASGYTFTSYWMHWVRQAPGQGLEWLGMIDPSNSETTLNQKFQGRVTMTV
DKSTNTVYMELTSLRSEDTAVYYCARSRGNYAYEMDYWGQGTLVTVSS (SEQ ID NO: 2000)

VH EVQLVQSGAEVKKPGASVKVSCKASGYTFTDYEMHWVRQAPGQGLEWMGIIDPGTGGTAYNQKFQGRVTMTA
DKSTSTVYMELSSLRSEDTAVYYCTSEKFGSNYYFDYWGQGTLVTVSS (SEQ ID NO: 2001)

VH EVQLVQSGAEVKKPGASVKVSCKASGYTFTDYEMHWVRQAPGQGLEWMGIIDPGTGGTAYNQKFQGRVTMTA
DKSTNTVYMELSSLRSEDTAVYYCTSEKFGSNYYFDYWGQGTLVTVSS (SEQ ID NO: 2002)

VH EVQLVQSGAEVKKPGASVKVSCKASGYTFTDYEMHWVRQAPGQRLEWMGVIDPGTGGTAYNQKFQGRVTITA
DKSASTAYMELSSLRSEDTAVYYCTSEKFGSNYYFDYWGQGTLVTVSS (SEQ ID NO: 2003)

VL DIVLTQTPAIMSASPGEKVTLTCSASSSVSSNYLYWYQQRPGSSPKLWIYSTSNLASGVPARFSGSGSGTSY
SLTISSMEAEDAASYFCHQWSSYPPTFGSGTKLEIK (SEQ ID NO: 2004)

VL DIVITQTTAIMSASPGEKVTLTCSASSSVSSNYLYWYQQRPGSSPKLWIYSTSNLASGVPARFSGSGSGTSY
SLTISSMEAEDAASYFCHQWSSYPPTFGSGTKLEIK (SEQ ID NO: 2005)

VL DIVMTQTPATMSASPGEKVTLTCSASSSVNSNYLYWYQQKPGSSPKVWIYSTSNLASGVPARFSGSGSGTSY
SLTISSMEAEDAASYFCHQWSSYPPTFGSGTKLELK (SEQ ID NO: 2006)

VL DIVMTQTTATMSASPGEKVTLTCSASSSVNSNYLYWYQQKPGSSPKVWIYSTSNLASGVPARFSGSGSGTSY
SLTISSMEAEDAASYFCHQWSSYPPTFGSGTKLELK (SEQ ID NO: 2007)

VL DIVLTQSTAIMSASPGEKVTLTCSASSGVNSNYLYWYQQKPGSSPKLWIYSTSNLASGVPARFSGSGSGTSY
SLTISSVEAEDAASYFCHQWSSYPPTFGSGTKLEIK (SEQ ID NO: 2008)

VL DIVLTQTPSSLSASLGDRVTISCSASQGISNYLNWYQQKPDGTVKLLIYYTSSLHSGVPSRFSGSGSGTDYS
LTISNLEPEDIATYYCQQYSKLPWTFGGGTKLEIK (SEQ ID NO: 2009)

VL DIVLTQSPSSLSASLGDRVTISCSASQGISNYLNWYQQKPDGTVKLLIYYTSSLHSGVPSRFSGSGSGTDYS
LTISNLEPEDIATYYCQQYSKLPWTFGGGTKLEIK (SEQ ID NO: 2010)

VL DIVITQSPSSLSASLGDRVTISCSASQGISNYLNWYQQKPDGTVKLLIYYTSSLHSGVPSRFSGSGSGTDYS
LTISNLEPEDIATYYCQQYSELPWTFGGGTKLEIK (SEQ ID NO: 2011)

VL DIVMTQSPSSLSASLGDRVTISCSASQGISNYLNWYQQRPDGTVKLLIYYTSSLHSGVPSRFSGSGSGTDYS
LTISNLEPEDIATYYCQQYSNLPWTFGGGTKLEIK (SEQ ID NO: 2012)

VL DIVMTQSPSSLSASLGDRVTISCSASQGISNYLNWYQQKPDGTVKLLIYYTSSLHSGVPSRFSGSGSGTDYS
LTISNLEPEDIATYYCQQYSELPWTFGGGTKLEIK (SEQ ID NO: 2013)

VL DIVMTQSTSSLSASLGDRVTISCSASQGISHYLNWYQQKPDGTVKLLIYYTSSLHSGVPSRFSGSGSGTDYS
LTIRNLEPEDIATYYCQQYSELPWTFGGGTKLEIK (SEQ ID NO: 2014)

VL DIVMTQSPSSLSASLGDRVTISCSASQGISHYLNWYQQKPDGTVKLLIYYTSSLHSGVPSRFSGSGSGTDYS
LTIRNLEPEDIATYYCQQYSELPWTFGGGTKLEIK (SEQ ID NO: 2015)

VL DIVMTQSPSSLSASLGDRVTISCSASQDISSYLNWYQQKPDGTVKLLIYYTSSLHSGVPSRFSGSGSGTDYS
LTISNLEPEDIATYYCQQYSELPWTFGGGTKLEIK (SEQ ID NO: 2016)

VL DIVMTQTPSSLSASLGDRVTISCSASQGISYYLNWYQQKPDGTIKLLIYYTLSLHSGVPSRFSGSGSGTDYS
LTISNLEPEDIATYYCQQYSELPWTFGGGTKLEIK (SEQ ID NO: 2017)

VL DIVMTQTPSSMSASLGDRVTISCSASQGISNYLNWYQQKPDGTVKLLIYYTSSLHSGVPSRFSGSGSGTDYS
LTISNLEPEDIATYYCQQYSYLPWTFGGGTKLEIK (SEQ ID NO: 2018)

VL DIVMTQTPSSLSASLGDRVTISCSASQGIGNYLNWYQQKPDGTVKLLIYYTSNLHSGVPSRFSGRGSGTDYS
LTISNLEPEDIATYYCQQYSNLPWTFGGGTKLEIK (SEQ ID NO: 2019)

VL DIVMTQSPSSLSASLGDRVTISCSASQGISNYLNWYQQKPDGTVKLLIYYTSNLHSGVPSRFSGSGSGTDYS
LTISDLAPEDIATYYCQQYSYLPWTFGGGTKLEIK (SEQ ID NO: 2020)

VL DIVITQSPLSLPVGLGDQASISCRSSQSLVHSNGNTYLHWYLQKPGQSPKLLIYKVSNRFSGVPDRFSGSGS
GTDFTLKISRVEAEDLGVYFCSQSTHVPYTFGGGTKLEIK (SEQ ID NO: 2021)

VL DIVLTQTPLSLPVSLGDQASISCRSSQSIVHSNGNTYLEWYLQKPGQSPKLLIYKVSNRFSGVPDRFSGSGS
GTNFTLKISRVEAEDLGVYYCFQGSHVPLTFGAGTKLELK (SEQ ID NO: 2022)

VL DIVLTQSPLSLPVSLGDQASISCRSSQSIVHSDGNTYLEWYLQKPGQSPKLLIYKVSNRFSGVPDRFSGSGS
GTDFTLKISRVEAEDLGIYYCFQGSHVPLTFGAGTKLELK (SEQ ID NO: 2023)

TABLE 7-continued

Variable Heavy Chain Region (VH) and Variable Light Chain Region
(VL) Sequences for Activatable Antibodies that Bind PD-1

VL DIVITQTPLSLPVSLGDQASISCRSSQTIVHSDGNTYLEWYLQKPGQSPKLLIYKVSNRFSGVPDRFSGSGS
GTDFTLKISRVEAEDLGVYYCFQGSHVPLTFGAGTKLEIK (SEQ ID NO: 2024)

VL DIVMTQSTLSLPVSLGDQVSISCRSSQSIVHSDGNTYLEWYLQKPGQSPNLLIYKVSNRFSGVPDRFSGSGS
GTDFTLKISRVEAEDLGVYYCFQGSHVPLTFGAGTKLELK (SEQ ID NO: 2025)

VL DIVLTQDELSNPVTSGESVSISCRSSKSLLYKDGKTYLNWFLQRPGQSPQVLIYFMSTRASGVSDRFSGSGS
GTDFTLEISRVKAEDVGVYYCQQLVDFPFTFGSGTKLELK (SEQ ID NO: 2026)

VL DIVMTQDELYNPVTSGESVSISCRSSKSLLYKDGKTYLNWFLQRPGQSPQVLIYFMSTRASGVSDRFSGSGS
GTDFTLEISRVKAEDVGVYYCQQLVDFPFTFGSGTKLEIK (SEQ ID NO: 2027)

VL DIVMTQSPSSLTVTAGEKVTMSCKSSQSLLNSGTQKNYLTWYQQKPGQPPKLLIYWASTRESGVPDRFTGSG
SGTDFTLTISSVQAEDLAVYYCQNDYSYPLTFGAGTKLEIK (SEQ ID NO: 2028)

VL DIVLTQTTATLSVTPGDRVSLSCRASQSISDYLHWYQQKSHESPRLLIKYASQSISGIPSRFSGSGSGSDFT
LTVNSVEPEDVGVYYCQNGHSYPYTFGGGTKLEIK (SEQ ID NO: 2029)

VL DIVLTQSPDTLSVTPGDRVSLSCRASQSISDYLHWYQQKSHESPRLLIKYASQSISGIPSRFSGSGSGSDFT
LSINSVEPEDVGVYYCQNGHSYPYTFGGGTKLELK (SEQ ID NO: 2030)

VL EIVLTQSPATLSLSPGERATLSCRASSSVSSNYLYWYQQKPGQAPRLLIYSTSNRATGIPARFSGSGSGTDY
TLTISSLEPEDFAVYYCHQWSSYPPTFGQGTKLEIK (SEQ ID NO: 2031)

VL DIVLTQSPATLSLSPGERATLSCRASSSVSSNYLYWYQQKPGQAPRLLIYSTSNLATGIPARFSGSGSGTDY
TLTISSLEPEDFAVYFCHQWSSYPPTFGQGTKLEIK (SEQ ID NO: 2032)

VL DIVLTQSPGTLSLSPGEKVTLSCRASSSVSSNYLYWYQQKPGQAPRLVIYSTSNLATGIPDRFSGSGSGTDY
TLTISRLEPEDFAVYFCHQWSSYPPTFGQGTKVEIK (SEQ ID NO: 2034)

VL DVVMTQSPLSLPVTLGQPASISCRSSQTIVHSDGNTYLEWYQQRPGQSPRLLIYKVSNRFSGVPDRFSGSGS
GTDFTLKISRVEAEDVGVYYCFQGSHVPLTFGQGTKLEIK (SEQ ID NO: 2035)

VL DIVMTQSPLSLPVTLGQPASISCRSSQTIVHSDGNTYLEWYQQRPGQSPKLLIYKVSNRFSGVPDRFSGSGS
GTDFTLKISRVEAEDVGVYYCFQGSHVPLTFGQGTKLEIK (SEQ ID NO: 2036)

VL DIVMTQTPLSSPVTLGQPASISCRSSQTIVHSDGNTYLEWYQQRPGQPPRLLIYKVSNRFSGVPDRFSGSGA
GTDFTLKISRVEAEDVGVYYCFQGSHVPLTFGQGTKLEIK (SEQ ID NO: 2037)

Note that (i) the sequences provided for Group B, Group P, Group Q, and Group V and designated as "HC" and "LC" are heavy chain and light chain amino acid sequences; all other sequences presented in Table 7 are variable heavy chain and variable light chain sequences; (ii) the sequence provided in Group D is a fusion protein comprising a B7-DC polypeptide and an immunoglobulin polypeptide; and (iii) in Group I, the last sequence is a bispecific antibody (BsAb) sequence.

In some embodiments, the activatable anti-PD-1 antibody includes a CDR sequence shown in Table 8, a combination of VL CDR sequences (VL CDR1, VL CDR2, VL CDR3) selected from the group consisting of those combinations shown in a single row Table 8, a combination of VH CDR sequences (VH CDR1, VH CDR2, VH CDR3) selected from the group consisting of those combinations shown in Table 8, or a combination of VL CDR and VH CDR sequences (VL CDR1, VL CDR2, VL CDR3, VH CDR1, VH CDR2, VH CDR3) selected the group consisting of those combinations shown in Table 8. The CDR regions were defined according to AbM definition as described in the CDR definition table in Andrew C.R. Martin's Bioinformatics Group website at UCL.

TABLE 8

CDR Sequences for Antibodies and Activatable Antibodies that Bind PD-1

| AB Name | VH CDR1 (SEQ ID NO) | VH CDR2 (SEQ ID NO) | VH CDR3 (SEQ ID NO) | VL CDR1 (SEQ ID NO) | VL CDR2 (SEQ ID NO) | VL CDR3 (SEQ ID NO) |
|---|---|---|---|---|---|---|
| M13 | GFTFSGYAMS (653) | YISNSGGNAH (658) | EDYGTSPFVY (664) | RASESVDNYGIS FMN (669) | AASNQGS (678) | QQSKDVPWT (683) |
| M19 | GYTFTDYYMD (654) | YIYPKNGGSS (659) | KVVATDY (665) | KSSQSLLYSSNQ KNYL (670) | WASIRES (679) | QQCDSYPWT (684) |
| M3 | GFTFSNYAMS (655) | YISNGGGDTH (660) | ENYGTSPFVY (666) | RASESVDNYGIS FMN (669) | AASNQGS (678) | QQSKDVPWT (683) |

TABLE 8-continued

CDR Sequences for Antibodies and Activatable Antibodies that Bind PD-1

| AB Name | VH CDR1 (SEQ ID NO) | VH CDR2 (SEQ ID NO) | VH CDR3 (SEQ ID NO) | VL CDR1 (SEQ ID NO) | VL CDR2 (SEQ ID NO) | VL CDR3 (SEQ ID NO) |
|---|---|---|---|---|---|---|
| M5 | GFSFSSYDMS (656) | TISGGGRYTY (661) | NYYGFDY (667) | KASQDVGTAVA (671) | WASTRHT (680) | QQYSSYPWT (685) |
| M14 | GFTFSSYGMS (657) | TISGGGRDIY (662) | LYLGFDY (668) | LASQTIGTWLA (672) | AATSLAD (681) | QQLYSIPWT (686) |
| A | GFTFSGYAMS (653) | YISNSGGNAH (658) | EDYGTSPFVY (664) | | | |
| Ab | GFTFSGYAMS (653) | YISNSGGNAH (658) | EDYGTSPFVY (664) | | | |
| Ae | GFTFSGYAMS (653) | YISNSGGNTH (663) | EDYGTSPFVY (664) | | | |
| Af | GFTFSGYAMS (653) | YISNSGGNTH (663) | EDYGTSPFVY (664) | | | |
| Ba | GYTFTDYYMD (654) | YIYPKNGGSS (659) | KVVATDY (665) | | | |
| Bb | GYTFTDYYMD (654) | YIYPKNGGSS (659) | KVVATDY (665) | | | |
| C | GFTFSNYAMS (655) | YISNGGGDTH (660) | ENYGTSPFVY (666) | | | |
| Ca | GFTFSNYAMS (655) | AYISNQGGDTH (2041) | ENYGTSPFVY (666) | | | |
| D | GFSFSSYDMS (656) | TISGGGRYTY (661) | NYYGFDY (667) | | | |
| 1.0 | | | | RASESVDNYGISFMN (673) | AASNQGS (678) | QQSKDVPWT (683) |
| 1.1 | | | | RASESVDNYGISFMN (673) | AASNQGS (678) | QQSKDVPWT (683) |
| 1.2 | | | | RASESVDQYGISFMN (674) | AASNQGS (678) | QQSKDVPWT (683) |
| 1.4 | | | | RASESVDSYGISFMN (675) | AASNQGS (678) | QQSKDVPWT (683) |
| 1.5 | | | | RASESVDAYGISFMN (676) | AASNQGS (678) | QQSKDVPWT (683) |
| 1.6 | | | | RASESVDNYGISFMN (673) | AASDQGS (682) | QQSKDVPWT (683) |
| cl 1.7 | | | | RASESVDAYGISFMN (676) | AASNQGS (678) | QQSKDVPWT (683) |
| 1.9 | | | | RASESVDAY (676)GISFMN | AASNQGS (678) | QQSKDVPWT (683) |
| 1.10 | | | | RASESVDAYGISFMN (676) | AASNQGS (678) | QQSKDVPWT (683) |
| 2 | | | | KSSQSLLYSSNQKNYLA (677) | WASIRES (679) | QQSDSYPWT (687) |
| 4 | | | | KASQDVGTAVA (671) | WASTRHT (680) | QQYSSYPWT (685) |

In some embodiments, the activatable anti-PD-1 antibody comprises or is derived from an antibody that is manufactured, secreted or otherwise produced by a hybridoma, such as, for example, the hybridoma(s) disclosed in U.S. Pat. No. 8,927,697 and US Patent Application Publication Nos. US 2011-0171215 and US 2015-0152180, and deposited at the European Collection of Cell Cultures (ECACC) under Accession Number 08090902; 08090903; and Ser. No. 08/090,901.

In some embodiments, the activatable anti-PD-1 antibody comprises or is derived from an antibody that is manufactured, secreted or otherwise produced by a hybridoma, such as, for example, the hybridoma(s) disclosed in US Patent Application Publication No. US 2014-0335093, and deposited at the Collection Nationale De Cultures De Microorganismes (CNCM) under deposit number 1-4122.

In some embodiments, the activatable anti-PD-1 antibody comprises or is derived from an antibody that is manufactured, secreted or otherwise produced by a hybridoma, such as, for example, the hybridoma(s) disclosed in PCT Publication Nos. WO 2015/058573 or WO 2014/206107, and deposited at the China Culture Collection Committee General Microbiology Center under Accession no. 8351.

In some embodiments, the activatable anti-PD-1 antibody comprises or is derived from an antibody that is manufactured, secreted or otherwise produced by a hybridoma, such as, for example, the hybridoma(s) disclosed in US Patent Application Publication No. US2011177088, and deposited at the Collection Nationale De Cultures De Microorganismes (CNCM) under deposit number 1-3745.

In some embodiments, the activatable anti-PD-1 antibody includes a CDR sequence shown in Table 9, a combination of VL CDR sequences selected from the group consisting of those combinations shown in Table 9, and/or a combination of VH CDR sequences selected from the group consisting of those combinations shown in Table 9.

In some embodiments, the activatable anti-PD-1 antibody includes a combination of heavy chain CDR sequences selected from the group consisting of the combinations shown in Group A in Table 9. In some embodiments, the activatable anti-PD-1 antibody includes a combination of light chain CDR sequences selected from the group consisting of the combinations shown in Group A in Table 9. In some embodiments, the activatable anti-PD-1 antibody includes a combination of heavy chain CDR sequences selected from the group consisting of the combinations shown in Group A in Table 9, and a combination of light chain CDR sequences selected from the group consisting of the combinations shown in Group A in Table 9.

In some embodiments, the activatable anti-PD-1 antibody includes a combination of heavy chain CDR sequences selected from the group consisting of the combinations shown in Group B in Table 9. In some embodiments, the activatable anti-PD-1 antibody includes a combination of light chain CDR sequences selected from the group consisting of the combinations shown in Group B in Table 9. In some embodiments, the activatable anti-PD-1 antibody includes a combination of heavy chain CDR sequences selected from the group consisting of the combinations shown in Group B in Table 9, and a combination of light chain CDR sequences selected from the group consisting of the combinations shown in Group B in Table 9.

In some embodiments, the activatable anti-PD-1 antibody includes a combination of heavy chain CDR sequences selected from the group consisting of the combinations shown in Group C in Table 9. In some embodiments, the activatable anti-PD-1 antibody includes a combination of light chain CDR sequences selected from the group consisting of the combinations shown in Group C in Table 9. In some embodiments, the activatable anti-PD-1 antibody includes a combination of heavy chain CDR sequences selected from the group consisting of the combinations shown in Group C in Table 9, and a combination of light chain CDR sequences selected from the group consisting of the combinations shown in Group C in Table 9.

In some embodiments, the activatable anti-PD-1 antibody includes a combination of heavy chain CDR sequences selected from the group consisting of the combinations shown in Group E in Table 9. In some embodiments, the activatable anti-PD-1 antibody includes a combination of light chain CDR sequences selected from the group consisting of the combinations shown in Group E in Table 9. In some embodiments, the activatable anti-PD-1 antibody includes a combination of heavy chain CDR sequences selected from the group consisting of the combinations shown in Group E in Table 9, and a combination of light chain CDR sequences selected from the group consisting of the combinations shown in Group E in Table 9.

In some embodiments, the activatable anti-PD-1 antibody includes a combination of heavy chain CDR sequences selected from the group consisting of the combinations shown in Group F in Table 9. In some embodiments, the activatable anti-PD-1 antibody includes a combination of light chain CDR sequences selected from the group consisting of the combinations shown in Group F in Table 9. In some embodiments, the activatable anti-PD-1 antibody includes a combination of heavy chain CDR sequences selected from the group consisting of the combinations shown in Group F in Table 9, and a combination of light chain CDR sequences selected from the group consisting of the combinations shown in Group F in Table 9.

In some embodiments, the activatable anti-PD-1 antibody includes a combination of heavy chain CDR sequences selected from the group consisting of the combinations shown in Group G in Table 9. In some embodiments, the activatable anti-PD-1 antibody includes a combination of light chain CDR sequences selected from the group consisting of the combinations shown in Group G in Table 9. In some embodiments, the activatable anti-PD-1 antibody includes a combination of heavy chain CDR sequences selected from the group consisting of the combinations shown in Group G in Table 9, and a combination of light chain CDR sequences selected from the group consisting of the combinations shown in Group G in Table 9.

In some embodiments, the activatable anti-PD-1 antibody includes a combination of heavy chain CDR sequences selected from the group consisting of the combinations shown in Group H in Table 9. In some embodiments, the activatable anti-PD-1 antibody includes a combination of light chain CDR sequences selected from the group consisting of the combinations shown in Group H in Table 9. In some embodiments, the activatable anti-PD-1 antibody includes a combination of heavy chain CDR sequences selected from the group consisting of the combinations shown in Group H in Table 9, and a combination of light chain CDR sequences selected from the group consisting of the combinations shown in Group H in Table 9.

In some embodiments, the activatable anti-PD-1 antibody includes a combination of heavy chain CDR sequences selected from the group consisting of the combinations shown in Group L in Table 9. In some embodiments, the activatable anti-PD-1 antibody includes a combination of light chain CDR sequences selected from the group consisting of the combinations shown in Group L in Table 9. In some embodiments, the activatable anti-PD-1 antibody includes a combination of heavy chain CDR sequences selected from the group consisting of the combinations shown in Group L in Table 9, and a combination of light chain CDR sequences selected from the group consisting of the combinations shown in Group L in Table 9.

In some embodiments, the activatable anti-PD-1 antibody includes a combination of heavy chain CDR sequences selected from the group consisting of the combinations shown in Group M in Table 9. In some embodiments, the activatable anti-PD-1 antibody includes a combination of light chain CDR sequences selected from the group consisting of the combinations shown in Group M in Table 9. In some embodiments, the activatable anti-PD-1 antibody includes a combination of heavy chain CDR sequences selected from the group consisting of the combinations shown in Group M in Table 9, and a combination of light chain CDR sequences selected from the group consisting of the combinations shown in Group M in Table 9.

In some embodiments, the activatable anti-PD-1 antibody includes a combination of heavy chain CDR sequences selected from the group consisting of the combinations shown in Group N in Table 9. In some embodiments, the activatable anti-PD-1 antibody includes a combination of light chain CDR sequences selected from the group consisting of the combinations shown in Group N in Table 9. In some embodiments, the activatable anti-PD-1 antibody includes a combination of heavy chain CDR sequences selected from the group consisting of the combinations shown in Group N in Table 9, and a combination of light chain CDR sequences selected from the group consisting of the combinations shown in Group N in Table 9.

In some embodiments, the activatable anti-PD-1 antibody includes a combination of heavy chain CDR sequences selected from the group consisting of the combinations shown in Group O in Table 9. In some embodiments, the activatable anti-PD-1 antibody includes a combination of light chain CDR sequences selected from the group consisting of the combinations shown in Group O in Table 9. In some embodiments, the activatable anti-PD-1 antibody includes a combination of heavy chain CDR sequences selected from the group consisting of the combinations shown in Group O in Table 9, and a combination of light chain CDR sequences selected from the group consisting of the combinations shown in Group O in Table 9.

In some embodiments, the activatable anti-PD-1 antibody includes a combination of heavy chain CDR sequences selected from the group consisting of the combinations shown in Group P in Table 9. In some embodiments, the activatable anti-PD-1 antibody includes a combination of light chain CDR sequences selected from the group consisting of the combinations shown in Group P in Table 9. In some embodiments, the activatable anti-PD-1 antibody includes a combination of heavy chain CDR sequences selected from the group consisting of the combinations shown in Group P in Table 9, and a combination of light chain CDR sequences selected from the group consisting of the combinations shown in Group P in Table 9.

In some embodiments, the activatable anti-PD-1 antibody includes a combination of heavy chain CDR sequences selected from the group consisting of the combinations shown in Group Q in Table 9. In some embodiments, the activatable anti-PD-1 antibody includes a combination of light chain CDR sequences selected from the group consisting of the combinations shown in Group Q in Table 9. In some embodiments, the activatable anti-PD-1 antibody includes a combination of heavy chain CDR sequences selected from the group consisting of the combinations shown in Group Q in Table 9, and a combination of light chain CDR sequences selected from the group consisting of the combinations shown in Group Q in Table 9.

In some embodiments, the activatable anti-PD-1 antibody includes a combination of heavy chain CDR sequences selected from the group consisting of the combinations shown in Group R in Table 9. In some embodiments, the activatable anti-PD-1 antibody includes a combination of light chain CDR sequences selected from the group consisting of the combinations shown in Group R in Table 9. In some embodiments, the activatable anti-PD-1 antibody includes a combination of heavy chain CDR sequences selected from the group consisting of the combinations shown in Group R in Table 9, and a combination of light chain CDR sequences selected from the group consisting of the combinations shown in Group R in Table 9.

In some embodiments, the activatable anti-PD-1 antibody includes a combination of heavy chain CDR sequences selected from the group consisting of the combinations shown in Group T in Table 9. In some embodiments, the activatable anti-PD-1 antibody includes a combination of light chain CDR sequences selected from the group consisting of the combinations shown in Group T in Table 9. In some embodiments, the activatable anti-PD-1 antibody includes a combination of heavy chain CDR sequences selected from the group consisting of the combinations shown in Group T in Table 9, and a combination of light chain CDR sequences selected from the group consisting of the combinations shown in Group T in Table 9.

In some embodiments, the activatable anti-PD-1 antibody includes a combination of heavy chain CDR sequences selected from the group consisting of the combinations shown in Group U in Table 9. In some embodiments, the activatable anti-PD-1 antibody includes a combination of light chain CDR sequences selected from the group consisting of the combinations shown in Group U in Table 9. In some embodiments, the activatable anti-PD-1 antibody includes a combination of heavy chain CDR sequences selected from the group consisting of the combinations shown in Group U in Table 9, and a combination of light chain CDR sequences selected from the group consisting of the combinations shown in Group U in Table 9.

In some embodiments, the activatable anti-PD-1 antibody includes a combination of heavy chain CDR sequences selected from the group consisting of the combinations shown in Group V in Table 9. In some embodiments, the activatable anti-PD-1 antibody includes a combination of light chain CDR sequences selected from the group consisting of the combinations shown in Group V in Table 9. In some embodiments, the activatable anti-PD-1 antibody includes a combination of heavy chain CDR sequences selected from the group consisting of the combinations shown in Group V in Table 9, and a combination of light chain CDR sequences selected from the group consisting of the combinations shown in Group V in Table 9.

In some embodiments, the activatable anti-PD-1 antibody includes a combination of heavy chain CDR sequences selected from the group consisting of the combinations shown in Group W in Table 9. In some embodiments, the activatable anti-PD-1 antibody includes a combination of light chain CDR sequences selected from the group consisting of the combinations shown in Group W in Table 9. In some embodiments, the activatable anti-PD-1 antibody includes a combination of heavy chain CDR sequences selected from the group consisting of the combinations shown in Group W in Table 9, and a combination of light chain CDR sequences selected from the group consisting of the combinations shown in Group W in Table 9.

In some embodiments, the activatable anti-PD-1 antibody includes a combination of heavy chain CDR sequences selected from the group consisting of the combinations shown in Group X in Table 9. In some embodiments, the activatable anti-PD-1 antibody includes a combination of light chain CDR sequences selected from the group consisting of the combinations shown in Group X in Table 9. In some embodiments, the activatable anti-PD-1 antibody includes a combination of heavy chain CDR sequences selected from the group consisting of the combinations shown in Group X in Table 9, and a combination of light chain CDR sequences selected from the group consisting of the combinations shown in Group X in Table 9.

TABLE 9

Additional CDR Sequences for Antibodies and Activatable Antibodies that Bind PD-1

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| Group A | | | | | |
| NYGMH (688) | VIWYDGSNKYYADSVKG (694) | NDDY (700) | RASQSVSSYLA (704) | DASNRAT (706) | QQRSNWPLT (710) |
| NYGFH (689) | VIWYDGSKKYYADSVKG (695) | GDDY (701) | RASQSVSSYLA (704) | DTSNRAT (707) | QQRSNWPLT (710) |
| NYGMH (688) | LIWYDGSNKYYADSVKG (696) | NVDH (702) | RASQSVSSYLA (704) | DASNRAT (706) | QQSSNWPRT (711) |
| NSGMH (690) | VIWYDGSKRYYADSVKG (697) | NDDY (700) | RASQSVSSYLA (704) | DASNRAT (706) | QQSSNWPRT (711) |
| RSSFFWG (691) | SIYYSGSTYYNPSLKS (698) | DYDILTGDEDY (703) | RASQGISSWLA (705) | AASNLRS (708) | QQYYSYPRT (712) |
| SYGFH (692) | VIWYDGSKKYYADSVKG (695) | GDDY (701) | RASQSVSSYLA (704) | DASNRAT (706) | QQRSNWPLT (710) |
| RSSYFWG (693) | SIFYSGETYFNPSLKS (699) | DYDILTGDEDY (703) | RASQGISSWLA (705) | AASSLQS (709) | QQYYSYPRT (712) |
| Group B | | | | | |
| SYYLY (713) | GVNPSNGGTNFSEKFKS (715) | RDSNYDGGFDY (717) | RASKSVSTSGFSYLH (719) | LASNLES (721) | QHSWELPLT (723) |
| NYYMY (714) | GINPSNGGTNFNEKFKN (716) | RDYRFDMGFDY (718) | RASKGVSTSGYSYLH (720) | LASYLES (722) | QHSRDLPLT (724) |
| AASGFTFSSYAMS (627) | TITGGGRNTYYPDSVKG (817) | QGYDGYTWFAY (823) | RASESVDNSGISFMN (830) | AASNPGS (836) | QQSKEVPWT (840) |
| AASGFTFSSFGMS (811) | TISGGGSNTYYPDSVKG (818) | IYDVAWFAY (824) | RSSQTIVHSDGNTYLE (831) | AASNQGS (678) | FQGSHVPYT (841) |
| KGSGYSFTDYALH (812) | VISTHYGDTVYNQRFKG (1832) | EGYGSLFYFDQ (825) | RASESVDSYGNSFMN (832) | KVSNRFS (837) | QQNNEVPLT (842) |
| KASGYAFTSYNIY (813) | YIDLYNGDTSYNEKF (819) | EGRLSFDY (826) | RSSQSIVQSNGNTYLE (833) | LASNLDS (838) | FQGSHVPYT (843) |
| AASGFTFSNYDMS (814) | YISGGGGNTYYPDTL (820) | ISLTGIFDY (827) | RSSQTIVHGNGNTYLE (834) | SASTLAS (839) | QQGFGTSNVENP (844) |
| AASGFTFNSYGMS (815) | TISGGGSYTYYPDSVQG (821) | GNYVYVMDY (828) | QASENIYSSLA (835) | | |
| KGSGYIFTDYVMH (816) | VISTYYSNINYNQKFKG (822) | EGFGRPYWYFDV (829) | | | |

TABLE 9-continued

Additional CDR Sequences for Antibodies and Activatable Antibodies that Bind PD-1

| VH CDR1 (SEQ ID NO:) | VH CDR2 (SEQ ID NO:) | VH CDR3 (SEQ ID NO:) | VL CDR1 (SEQ ID NO:) | VL CDR2 (SEQ ID NO:) | VL CDR3 (SEQ ID NO:) |
|---|---|---|---|---|---|
| Group C | | | | | |
| GYSITSDYAWN (845) | YINYSGSTSYNPSLKS (847) | WIGSSAWYFDV (849) | RSGQNIVHSNGNTYLE (851) | KVSNRFF (853) | FQGSHVPFT (855) |
| GYTFTTYYLY (846) | GINPSNGGINFNEKFK (848) | RDYRYDRGFDY (850) | RASKSVSTSGFNYIH (852) | LASNLES (721) | QHSRELPLT (856) |
| Group E | | | | | |
| SYGIS (857) | WISAYNGNTNYAQKLQG (861) | DADYSSGSGY (865) | SGDALPKQYAY (869) | KDTERPS (872) | QSADNSITYRV (876) |
| SYYIH (858) | IINPRGATISYAQKFQG (862) | AGIYGFDFDY (866) | TGTSNDVGGYNYVS (870) | DVTNRPS (873) | SSYTIVTNFEVL (877) |
| SGAYYWS (859) | YIYYNGNTYYNPSLRS (863) | ASDYVWGGYRYMDAFDI (867) | SGSNSNIGSNSVN (871) | GNNQRPS (874) | AAWDDSLNGPV (878) |
| SSYWMS (860) | AISGSGGSTYYADSVKG (864) | ENWGSYFDL (868) | RASQGISSWLA (705) | KASTLES (875) | QQSYSTPWT (879) |
| Group F | | | | | |
| SSWIH (880) | YIYPSTGFTEYNQKFKD (881) | WRDSSGYHAMDY (882) | RASQSVSTSGYSYMH (883) | FGSNLES (884) | QHSWEIPYT (885) |
| Group L | | | | | |
| GFTFSSYDYMH (886) | VIWYSGSNTYYNDSLKS (887) | AYFGVDV (888) | RASQGIGNTLA (889) | RASQGIGNTLA (889) | QQYDHVPLT (891) |
| Group G | | | | | |
| GFSLTSYGVH (892) | VIWAGGSTNYNSALMS (895) | GFSLTSYGVH (896) | KASQSVSNDVA (898) | YAFHRFT (900) | |
| VIWAGGSTNYNPSLKS (893) | ARAYGNYWYIDV (896) | ARAYGNYWYIDV (897) | KSSESVSNDVA (899) | | |
| VIYAGGSTNYNPSLKS (894) | HQAYSSPYT (895) | | | | |
| Group H | | | | | |
| DYEMH (901) | VIESETGGTAYNQKFKG (902) | EGITTVATTYYWYFDV (903) | RSSQSIVHSNGNTYLE (904) | KVSNRFS (905) | FQGSHVPLT (906) |
| Group M | | | | | |
| GYTFTTYPIE (907) | NFHPYNDDTKYNEKFK (908) | | RASSSVISSYLH (909) | STSNLAS (910) | QQYNGYPLT (911) QQYNSYPLT (912) |
| Group N | | | | | |
| SYYLY (713) | GVNPSNGGTNFSEKFK (1596) | RDSNYDGGFDY (717) | RASKSVSTSGFSYLH (719) | LASNLES (721) | QHSWELPLT (723) |
| Group P | | | | | |
| GYTFTTY (854) | YPGTGG (1597) | WTTGTGAY (1598) | SQSLLDSGNQKNF (1599) | WAS (1600) | DYSYPY (1601) |

TABLE 9-continued

Additional CDR Sequences for Antibodies and Activatable Antibodies that Bind PD-1

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| TYWMH (1602) | NIYPGTGGSNFDE KFK (1603) | | KSSQSLLDSGNQKNFL (1833) | WASTRES (1604) | QNDYSYPYT (1605) |
| GYTFTTYW MH (1606) | | | | | |
| Group Q | | | | | |
| GFTFSSYT (1607) | ISDTGGNT (1608) | AKDQGGSYPYYF HY (1609) | QSISSY (1610) | AAS (1611) | QQSYSTPPIT (1612) |
| GFTVSNNY (1613) | IYSGGFT (1614) | ARYYYDTSDYWT FFDY (1615) | QSVSSN (1616) | GAS (1617) | QQYNNWPLT (1618) |
| GFTFSSYG (1619) | IWYDGSNI (1620) | ARPGHWNYFFEY (1621) | QSINNY (1622) | TAS (1623) | QQSYSTPPLT (1624) |
| GFTFRNYD (1625) | IGSAGDT (1626) | TRDIHCSSTRCY GMDV (1627) | QSISNY (1628) | AAS (1611) | QQSYSTPPIT (1612) |
| GFKFSNEW (1629) | IKSKTDGGTT (1630) | TTDQDFWSGYYT GADYYGMDV (1631) | | AAS (1611) | QQSYSTPPIT (1612) |
| GGSLNGYY (1632) | IDHSGST (1633) | AREGLLPFDY (1634) | QSVYSNY (1635) | AAS (1611) | HQYATSPWT (1636) |
| DDSISSTT YY (1637) | MSYNGNN (622) | ARHLGYNGNWYP FDF (1638) | QSVSSSY (1639) | GAS (1640) | QQYGSSPWT (1641) |
| GFTFDDYA (1642) | INWSGNNI (1643) | TKDISITGTLDA FDV (1644) | QGISNW (1645) | SAS (1646) | QQAHSFPLT (1647) |
| GFTFSSYG (1619) | IWSDGDSE (1648) | ARDRDLEDI (1649) | QGIRND (1650) | AAS (1611) | LQHNSYPLT (1651) |
| GFTFSNFG (1652) | ISGGGRDT (1653) | VKWGNIYFDY (1654) | LSINTF (1655) | AAS (1611) | QQSSNTPFT (1656) |
| GFTFDDYG (1657) | ISWNDGKT (1658) | ARDWQYLIERYF DY (1659) | QSVSSSY (1639) | GAS (1640) | QQYGSSPWT (1641) |
| GFTFDDYG (1657) | IGWTGGRS (1660) | ARDRQWLVQWYF DY (1661) | QSISSY (1610) | AAS (1611) | QQSYSTPPIT (1612) |
| GFTFDDYG (1657) | ISWNDGKT (1658) | ARDWQYLIDRYF DF (1662) | | | |
| GFTFDDYA (1642) | IGWSSGSI (1663) | AKAYTFMITLYF DY (1664) | | | |
| GFTFDDYD (1665) | SGWNRGSL (1666) | AKGFVVVSAAYF DY (1667) | | | |
| GVTFRNFA (1668) | IIPFFSAA (1669) | AREGERGHTYGF DY (1670) | | | |
| GFTFDDYA (1642) | INWNRGRT (1671) | AKAEQWLDEGYF DY (1672) | | | |
| GFTFEDYA (1673) | ISDSGGST (1674) | AKDQGGSYPYYF HY (1609) | | | |
| GYTFTSFY (1675) | IGWSNVKI (1676) | VKAYTSMLTLYF DY (1677) | | | |
| GGSISSYH (1678) | INPSDGST (1679) | ARRVAGDIFDI (1680) | | | |
| GFTFEDYG (1681) | IYYIGST (1682) | ARVPVGATGASD V (1683) | | | |

TABLE 9-continued

Additional CDR Sequences for Antibodies and Activatable Antibodies that Bind PD-1

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| GFTFSAYA (1684) | ISWTGGNT (1685) | TRDRQWLMQWYFDY (1686) | | | |
| GFALHDYA (1687) | ISYGGSDK (1688) | AKSAHWNFFFDY (1689) | | | |
| GDSISSTAYH (1687) | ISWNSGVI (1717) | AKGSGSYYVSWFDP (1718) | | | |
| GFTFSTYA (1690) | ITYNGNT (1691) IGGSGDST (1693) | ARHLGYNSDFFPFDF (1692) VKVRNYDGSFDI (1694) | | | |
| Group R | | | | | |
| SYGMS (1751) | TMSGGGRDIYYPDSMKG (1752) | QYYDDWFAY (1753) | RASQSISNNLH (1754) | YASQSIS (1755) | QQSNSWPLT (1756) |
| TYGVH (1757) | VIWSGGSTDYNAAFIS (1758) | EKSVYGNYVGAMDY (1759) | KASQSVSDDVA (1760) | YAFNRYT (1761) | QQDYRSPWT (1762) |
| SYGMS (1751) | TISGGGRDIYYPDSVKG (1763) | QYYDDWFAY (1753) | RASQSISNDLH (1764) | YVSQSIS (1765) | QQSDSWPLT (1766) |
| SDYAWN (1767) | YISYSGYTSYNPSLKS (1768) | SLDYDYGTMDY (1769) | RANSSVSSMH (1770) | AISNLAF (1771) | QQWSSRPPT (1772) |
| SYDMS (1773) | TISGGGSYTYYQDSVKG (1774) | PYGPYFDY (1775) | HASQSINVWLS (1776) | ASNLHT (1777) | QQGQSYPWT (1778) |
| SDYAWN (1767) | YISYSGYTSYNPSLKS (1768) | SLDYDYGTMDY (1769) | RANSSVSSMH (1770) | AISNLAF (1771) | QQWNSRPPT (1779) |
| YYDMS (1780) | TISGGGRNTYFIDSVKG (1781) | PYEGAVDF (1782) | KASQDVDNAVA (1783) | WASTRHH (1784) | QQYSTFPYT (1785) |
| SYGMS (1751) | TISGGGRDTYYLDSVKG (1786) | QYYDDWFAY (1753) | RASQSLSNNLH (1787) | YASQSIS (1755) | QQSNSWPLT (1756) |
| NNWIG (1788) | DFYPGGGYTNYNEKFKG (1789) | GYGTNYWYFDV (1790) | KASQSVSNDVA (1791) | YAFTRYI (1792) | QQDYSSPYT (1793) |
| NFGMN (1794) | WISGYTREPTYAADFKG (1795) | DVFDY (1796) | RASESVDNYGYSFMN (1797) | RASNLES (1798) | QQSNADPT (1799) |
| Group T | | | | | |
| GYTFTSYYMY (1800) | GVNPSNGGTNFNEKFKS (1801) | RDYRYDMGFDY (1802) | RASKGVSTSGYSYLH (1803) | LASYLE (1804) | QHSRELPLT (1805) |
| GYTFTNYYMY (1806) | GINPSNGGTNYNEKFKN (890) | RDYRYDMGFDY (1802) | | | |
| Group U | | | | | |
| G (T/R/I) (F/L) (S/E/T/P/R) (T/S/H/Q/R/W) (F/Y/Q) (1881) | W (I/V) S A (Y/H) N G N T (K/N) Y A Q K L Q G (1882) | (Q/—) GY (G/D) (N/V) Y (L/S) (Y/W) (D/A) (Y/V) (1883) | S G D A L (P/T/S) (M/T/E/K) Q Y (G/A) Y (1884) | | Q Q (N/S/W) (Y/K/I) (N/E/S) (S/V/D/T) P (Y/W) T (1885) |

TABLE 9-continued

Additional CDR Sequences for Antibodies and Activatable Antibodies that Bind PD-1

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| (T/R/W/Q/H/S) (Y/F/Q) G (M/I) (1886) | (T/A) I S G (S/G) G (S/G) . (S/D/N) T Y Y (A/P/S) D S V (K/Q) G (1887) | D (A/V/S) (D/E) Y (S/G/R) (S/L/T) (1888), with the proviso that if A at position 2, then not D or S in position 5 | | | |
| | | GYALDY (2038) | | | |
| GYIFSSY (1889) | FPGSGS (1890) | GYGNYLYFDV (1891) | KASQSVSDDVA (1760) | YAFKRYI (1892) | QQNYNSPYT (1893) |
| SYWIG (1894) | KIFPGSGSADYNE NFKG (1895) | DSEYSSGSGY (1896) | SGDALTTQYAY (1897) | KDTERPS (872) | QSADNSITYR V (876) |
| | | QRDSAWFAS (2039) | RASESVDNSGISFMS (1898) | ATSKLAS (1899) | QQWISDPWT (1900) |
| | | | SGDALSEQYAY (1901) | TASNQGS (1902) | QQSKEVPWT (840) |
| | | | SGDALPKQYAY (869) | | |
| | | | SGDALPMQYGY (1903) | | |
| | | | RTSSSVNYMH (1904) | | |
| GYRFTWY (1905) | SAYNGN (1906) | DVDYSSGSGY (1907) | | | |
| WYGIS (1908) | WISAYNGNTNYAQ KLQG (861) | DAEYSLGSGY (1909) | | | |
| GYRFSTF (1910) | SAHNGN (1911) | DAEYGSGSGY (1912) | | | |
| TFGIS (1913) | WVSAHNGNTNYAQ KLQG (1914) | DADYGSGSGY (1915) | | | |
| GYRFETY (1916) | SYSGR (1917) | DVDYGTGSGY (1918) | | | |
| GYRFRQY (1919) | YISYSGRTSYNPS LTS (1920) | DVDYGSGSGY (1921) | | | |
| QYGIS (1922) | SGGGSD (1923) | DAEYGSGSGY (1912) | | | |
| GYRFTRY (1924) | TISGGGSDTYYPD SVQG (1925) | GYALDY (2038) | | | |
| RYGIS (1926) | | QGYDVYSWFAY (1927) | | | |
| GYRFPHY (1928) | | | | | |
| HYGIS (1929) | | | | | |
| GYRFTRQ (1930) | | | | | |

TABLE 9-continued

Additional CDR Sequences for Antibodies and Activatable Antibodies that Bind PD-1

| VH | | | VL | | |
|---|---|---|---|---|---|
| CDR1 (SEQ ID NO:) | CDR2 (SEQ ID NO:) | CDR3 (SEQ ID NO:) | CDR1 (SEQ ID NO:) | CDR2 (SEQ ID NO:) | CDR3 (SEQ ID NO:) |
| RQGIS (1931) | | | | | |
| GHSITSDY (1932) | | | | | |
| SDYAWN (1767) | | | | | |
| GFTFSTF (1933) | | | | | |
| TFGMS (1934) | | | | | |
| Group V | | | | | |
| GWSLTGPG (1935) | IYGDGST (1936) | AYEYAMDW (1937) | WSVSTSGKSY (1938) | LLS (1939) | YHIRDLT (2040) |
| Group W | | | | | |
| GYTFTSYW IN (1940) | YPGSSL (1941) | LSTGTFAY (1942) | KSSQSLWDSTNQKNFL T (1943) | WTSTRES (1944) | QNDYFYPLT (1945) |
| GYTFTSY (1946) | NIYPGSSLTNYNE KFKN (1947) | LTTGTFAY (1948) | KSSQSLWDSGNQKNFL T (1949) | WTSYRES (1950) | QNDYFYPHT (1951) |
| SYWIN (1952) | YPGSSI (1953) | LLTGTFAY (1954) | KSSQSLLDSGNQKNFL T (1955) | WTS(T/Y)RES (1956) | QNDYSYPLT (1957) |
| | NIYPGSSITNYNE KFKN (1958) | L(L/S)TGTFAY (1959) | KSSQSL(W/L)DS(G/T)NQKNFLT (1960) | | QNDY(F/S)YP(L/H)T (1961) |
| | WPGSSL (1962) | | | | |
| | NIWPGSSLTNYNE KFKN (1963) | | | | |
| | NIYPGSSSTNYNE KFKN (1964) | | | | |
| | NI(Y/W)PGSS(L/I/S)TNYNEK FKN (1965) | | | | |
| Group X | | | | | |
| GLTFSSSG (1966) | IWYDGSKR (1706) | ATNNDY (1967) | RASQSVSSYLA (704) | TASNRAT (1968) | QQYSNWPRT (1969) |

The ABs in the activatable antibodies of the disclosure specifically bind a PD-1 target, such as, for example, mammalian PD-1. In some embodiments, such Abs bind mammalian PD-1. In some embodiments, such Abs bind human PD-1. In some embodiments, such Abs bind non-human primate PD-1. Also included in the disclosure are ABs that bind to the same PD-1 epitope as an antibody of the disclosure and/or an activated activatable antibody described herein. Also included in the disclosure are ABs that compete with an anti-PD-1 antibody and/or an activated anti-PD-1 activatable antibody described herein for binding to a PD-1 target, e.g., human PD-1. Also included in the disclosure are ABs that cross-compete with an anti-PD-1 antibody and/or an activated anti-PD-1 activatable antibody described herein for binding to a PD-1 target, e.g., human PD-1.

The activatable anti-PD-1 antibodies provided herein include a masking moiety. In some embodiments, the masking moiety is an amino acid sequence that is coupled or otherwise attached to the anti-PD-1 antibody and is positioned within the activatable anti-PD-1 antibody construct such that the masking moiety reduces the ability of the anti-PD-1 antibody to specifically bind PD-1. Suitable masking moieties are identified using any of a variety of known techniques. For example, peptide masking moieties are identified using the methods described in PCT Publication No. WO 2009/025846 by Daugherty et al., the contents of which are hereby incorporated by reference in their entirety.

The activatable anti-PD-1 antibodies provided herein include a cleavable moiety. In some embodiments, the cleavable moiety includes an amino acid sequence that is a substrate for a protease, usually an extracellular protease. Suitable substrates are identified using any of a variety of known techniques. For example, peptide substrates are identified using the methods described in U.S. Pat. No. 7,666,817 by Daugherty et al.; in U.S. Pat. No. 8,563,269 by Stagliano et al.; and in PCT Publication No. WO 2014/026136 by La Porte et al., the contents of each of which are hereby incorporated by reference in their entirety. (See also Boulware et al. "Evolutionary optimization of peptide substrates for proteases that exhibit rapid hydrolysis kinetics." Biotechnol Bioeng. 106.3 (2010): 339-46).

Exemplary substrates include but are not limited to substrates cleavable by one or more of the following enzymes or proteases listed in Table 3.

masked until proteolytically activated at the site of disease. Starting with an anti-PD-1 antibody as a parental therapeutic antibody, the activatable anti-PD-1 antibodies of the invention were engineered by coupling the antibody to an inhibitory mask through a linker that incorporates a protease substrate.

When the AB is modified with a MM and is in the presence of the target, specific binding of the AB to its target is reduced or inhibited, as compared to the specific binding of the AB not modified with an MM or the specific binding of the parental AB to the target.

The $K_d$ of the AB modified with a MM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,

TABLE 3

Exemplary Proteases and/or Enzymes

| | | |
|---|---|---|
| ADAMS, ADAMTS, e.g. | Cysteine proteinases, e.g., | Serine proteases, e.g., |
| ADAM8 | Cruzipain | activated protein C |
| ADAM9 | Legumain | Cathepsin A |
| ADAM 10 | Otubain-2 | Cathepsin G |
| ADAM12 | KLKs, e.g., | Chymase |
| ADAM15 | KLK4 | coagulation factor proteases |
| ADAM17/TACE | KLK5 | (e.g., FVIIa, FIXa, FXa, FXIa, |
| ADAMDEC1 | KLK6 | FXIIa) |
| ADAMTS1 | KLK7 | Elastase |
| ADAMTS4 | KLK8 | Granzyme B |
| ADAMTS5 | KLK10 | Guanidinobenzoatase |
| Aspartate proteases, e.g., | KLK11 | HtrA1 |
| BACE | KLK13 | Human Neutrophil Elastase |
| Renin | KLK14 | Lactoferrin |
| Aspartic cathepsins, e.g., | Metallo proteinases, e.g., | Marapsin |
| Cathepsin D | Meprin | NS3/4A |
| Cathepsin E | Neprilysin | PACE4 |
| Caspases, e.g., | PSMA | Plasmin |
| Caspase 1 | BMP-1 | PSA |
| Caspase 2 | MMPs, e.g., | tPA |
| Caspase 3 | MMP1 | Thrombin |
| Caspase 4 | MMP2 | Tryptase |
| Caspase 5 | MMP3 | uPA |
| Caspase 6 | MMP7 | Type II Transmembrane |
| Caspase 7 | MMP8 | Serine Proteases (TTSPs), e.g., |
| Caspase 8 | MMP9 | DESC1 |
| Caspase 9 | MMP10 | DPP-4 |
| Caspase 10 | MMP11 | FAP |
| Caspase 14 | MMP12 | Hepsin |
| Cysteine cathepsins, e.g., | MMP13 | Matriptase-2 |
| Cathepsin B | MMP14 | MT-SP1/Matriptase |
| Cathepsin C | MMP15 | TMPRSS2 |
| Cathepsin K | MMP16 | TMPRSS3 |
| Cathepsin L | MMP17 | TMPRSS4 |
| Cathepsin S | MMP19 | |
| Cathepsin V/L2 | MMP20 | |
| Cathepsin X/Z/P | MMP23 | |
| | MMP24 | |
| | MMP26 | |
| | MMP27 | |

The activatable anti-PD-1 antibodies described herein overcome a limitation of antibody therapeutics, particularly antibody therapeutics that are known to be toxic to at least some degree in vivo. Target-mediated toxicity constitutes a major limitation for the development of therapeutic antibodies. The activatable anti-PD-1 antibodies provided herein are designed to address the toxicity associated with the inhibition of the target in normal tissues by traditional therapeutic antibodies. These activatable anti-PD-1 antibodies remain 000 times greater than the $K_d$ of the AB not modified with an MM or of the parental AB towards the target. Conversely, the binding affinity of the AB modified with a MM towards the target is at least 2, 3, 4, 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times lower than the binding affinity of the AB not modified with an MM or of the parental AB towards the target.

In some embodiments, the dissociation constant ($K_d$) of the MM towards the AB is generally greater than the $K_d$ of the AB towards the target. The $K_d$ of the MM towards the AB can be at least 5, 10, 25, 50, 100, 250, 500, 1,000, 2,500, 5,000, 10,000, 100,000, 1,000,000 or even 10,000,000 times greater than the $K_d$ of the AB towards the target. Conversely, the binding affinity of the MM towards the AB is generally lower than the binding affinity of the AB towards the target. The binding affinity of MM towards the AB can be at least 5, 10, 25, 50, 100, 250, 500, 1,000, 2,500, 5,000, 10,000, 100,000, 1,000,000 or even 10,000,000 times lower than the binding affinity of the AB towards the target.

In some embodiments, the dissociation constant ($K_d$) of the MM towards the AB is approximately equal to the $K_d$ of the AB towards the target. In some embodiments, the dissociation constant ($K_d$) of the MM towards the AB is no more than the dissociation constant of the AB towards the target.

In some embodiments, the dissociation constant ($K_d$) of the MM towards the AB is less than the dissociation constant of the AB towards the target.

In some embodiments, the dissociation constant ($K_d$) of the MM towards the AB is greater than the dissociation constant of the AB towards the target.

In some embodiments, the MM has a $K_d$ for binding to the AB that is no more than the $K_d$ for binding of the AB to the target.

In some embodiments, the MM has a $K_d$ for binding to the AB that is no less than the $K_d$ for binding of the AB to the target.

In some embodiments, the MM has a $K_d$ for binding to the AB that is approximately equal to the $K_d$ for binding of the AB to the target.

In some embodiments, the MM has a $K_d$ for binding to the AB that is less than the $K_d$ for binding of the AB to the target.

In some embodiments, the MM has a $K_d$ for binding to the AB that is greater than the $K_d$ for binding of the AB to the target.

In some embodiments, the MM has a $K_d$ for binding to the AB that is no more than 2, 3, 4, 5, 10, 25, 50, 100, 250, 500, or 1,000 fold greater than the $K_d$ for binding of the AB to the target. In some embodiments, the MM has a $K_d$ for binding to the AB that is between 1-5, 2-5, 2-10, 5-10, 5-20, 5-50, 5-100, 10-100, 10-1,000, 20-100, 20-1000, or 100-1,000 fold greater than the $K_d$ for binding of the AB to the target.

In some embodiments, the MM has an affinity for binding to the AB that is less than the affinity of binding of the AB to the target.

In some embodiments, the MM has an affinity for binding to the AB that is no more than the affinity of binding of the AB to the target.

In some embodiments, the MM has an affinity for binding to the AB that is approximately equal of the affinity of binding of the AB to the target.

In some embodiments, the MM has an affinity for binding to the AB that is no less than the affinity of binding of the AB to the target.

In some embodiments, the MM has an affinity for binding to the AB that is greater than the affinity of binding of the AB to the target.

In some embodiments, the MM has an affinity for binding to the AB that is 2, 3, 4, 5, 10, 25, 50, 100, 250, 500, or 1,000 less than the affinity of binding of the AB to the target. I In some embodiments, the MM has an affinity for binding to the AB that is between 1-5, 2-5, 2-10, 5-10, 5-20, 5-50, 5-100, 10-100, 10-1,000, 20-100, 20-1000, or 100-1,000 fold less than the affinity of binding of the AB to the target. In some embodiments, the MM has an affinity for binding to the AB that is 2 to 20 fold less than the affinity of binding of the AB to the target. In some embodiments, a MM not covalently linked to the AB and at equimolar concentration to the AB does not inhibit the binding of the AB to the target.

When the AB is modified with a MM and is in the presence of the target specific binding of the AB to its target is reduced or inhibited, as compared to the specific binding of the AB not modified with an MM or the specific binding of the parental AB to the target. When compared to the binding of the AB not modified with an MM or the binding of the parental AB to the target the AB's ability to bind the target when modified with an MM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or more when measured in vivo or in an in vitro assay.

The MM inhibits the binding of the AB to the target. The MM binds the antigen binding domain of the AB and inhibits binding of the AB to the target. The MM can sterically inhibit the binding of the AB to the target. The MM can allosterically inhibit the binding of the AB to its target. In these embodiments when the AB is modified or coupled to a MM and in the presence of target there is no binding or substantially no binding of the AB to the target, or no more than 0.001%, 0.01%, 0.1%, 1%, 2%, 3%, 4%, 5%, 6%, 7%, 8%, 9%, 10%, 15%, 20%, 25%, 30%, 35%, 40%, or 50% binding of the AB to the target, as compared to the binding of the AB not modified with an MM, the parental AB, or the AB not coupled to an MM to the target, for at least 2, 4, 6, 8, 12, 28, 24, 30, 36, 48, 60, 72, 84, or 96 hours, or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

When an AB is coupled to or modified by a MM, the MM 'masks' or reduces or otherwise inhibits the specific binding of the AB to the target. When an AB is coupled to or modified by a MM, such coupling or modification can effect a structural change that reduces or inhibits the ability of the AB to specifically bind its target.

An AB coupled to or modified with an MM can be represented by the following formulae (in order from an amino (N) terminal region to carboxyl (C) terminal region:

(MM)-(AB)

(AB)-(MM)

(MM)-L-(AB)

(AB)-L-(MM)

where MM is a masking moiety, the AB is an antibody or antibody fragment thereof, and the L is a linker. In many embodiments, it can be desirable to insert one or more linkers, e.g., flexible linkers, into the composition so as to provide for flexibility.

In certain embodiments, the MM is not a natural binding partner of the AB. In some embodiments, the MM contains no or substantially no homology to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 25% identical to any natural binding partner of the AB. In some embodiments, the MM is no more than 50% identical to any natural binding partner of the AB. In some embodiments, the MM is no more than 20% identical to any natural binding partner of the AB. In some embodiments, the MM is no more than 10% identical to any natural binding partner of the AB.

In some embodiments, the activatable antibodies include an AB that is modified by an MM and also includes one or more cleavable moieties (CM). Such activatable antibodies exhibit activatable/switchable binding, to the AB's target. Activatable antibodies generally include an antibody or antibody fragment (AB), modified by or coupled to a masking moiety (MM) and a modifiable or cleavable moiety (CM). In some embodiments, the CM contains an amino acid sequence that serves as a substrate for at least one protease.

The elements of the activatable antibodies are arranged so that the MM and CM are positioned such that in a cleaved (or relatively active) state and in the presence of a target, the AB binds a target while the activatable antibody is in an uncleaved (or relatively inactive) state in the presence of the target, specific binding of the AB to its target is reduced or inhibited. The specific binding of the AB to its target can be reduced due to the inhibition or masking of the AB's ability to specifically bind its target by the MM.

The $K_d$ of the AB modified with a MM and a CM towards the target is at least 5, 10, 25, 50, 100, 250, 500, 1,000, 2,500, 5,000, 10,000, 50,000, 100,000, 500,000, 1,000,000, 5,000,000, 10,000,000, 50,000,000 or greater, or between 5-10, 10-100, 10-1,000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000,000 times greater than the $K_d$ of the AB not modified with an MM and a CM or of the parental AB towards the target. Conversely, the binding affinity of the AB modified with a MM and a CM towards the target is at least 5, 10, 25, 50, 100, 250, 500, 1,000, 2,500, 5,000, 10,000, 50,000, 100,000, 500,000, 1,000,000, 5,000,000, 10,000, 000, 50,000,000 or greater, or between 5-10, 10-100, 10-1, 000, 10-10,000, 10-100,000, 10-1,000,000, 10-10,000,000, 100-1,000, 100-10,000, 100-100,000, 100-1,000,000, 100-10,000,000, 1,000-10,000, 1,000-100,000, 1,000-1,000,000, 1000-10,000,000, 10,000-100,000, 10,000-1,000,000, 10,000-10,000,000, 100,000-1,000,000, or 100,000-10,000, 000 times lower than the binding affinity of the AB not modified with an MM and a CM or of the parental AB towards the target.

When the AB is modified with a MM and a CM and is in the presence of the target but not in the presence of a modifying agent (for example at least one protease), specific binding of the AB to its target is reduced or inhibited, as compared to the specific binding of the AB not modified with an MM and a CM or of the parental AB to the target. When compared to the binding of the parental AB or the binding of an AB not modified with an MM and a CM to its target, the AB's ability to bind the target when modified with an MM and a CM can be reduced by at least 50%, 60%, 70%, 80%, 90%, 92%, 93%, 94%, 95%, 96%, 97%, 98%, 99% and even 100% for at least 2, 4, 6, 8, 12, 28, 24, 30, 36, 48, 60, 72, 84, or 96 hours or 5, 10, 15, 30, 45, 60, 90, 120, 150, or 180 days, or 1, 2, 3, 4, 5, 6, 7, 8, 9, 10, 11, or 12 months or longer when measured in vivo or in an in vitro assay.

As used herein, the term cleaved state refers to the condition of the activatable antibodies following modification of the CM by at least one protease. The term uncleaved state, as used herein, refers to the condition of the activatable antibodies in the absence of cleavage of the CM by a protease. As discussed above, the term "activatable antibodies" is used herein to refer to an activatable antibody in both its uncleaved (native) state, as well as in its cleaved state. It will be apparent to the ordinarily skilled artisan that in some embodiments a cleaved activatable antibody can lack an MM due to cleavage of the CM by protease, resulting in release of at least the MM (e.g., where the MM is not joined to the activatable antibodies by a covalent bond (e.g., a disulfide bond between cysteine residues).

By activatable or switchable is meant that the activatable antibody exhibits a first level of binding to a target when the activatable antibody is in a inhibited, masked or uncleaved state (i.e., a first conformation), and a second level of binding to the target in the uninhibited, unmasked and/or cleaved state (i.e., a second conformation), where the second level of target binding is greater than the first level of binding. In general, the access of target to the AB of the activatable antibody is greater in the presence of a cleaving agent capable of cleaving the CM, i.e., a protease, than in the absence of such a cleaving agent. Thus, when the activatable antibody is in the uncleaved state, the AB is inhibited from target binding and can be masked from target binding (i.e., the first conformation is such the AB cannot bind the target), and in the cleaved state the AB is not inhibited or is unmasked to target binding.

The CM and AB of the activatable antibodies are selected so that the AB represents a binding moiety for a given target, and the CM represents a substrate for a protease. In some embodiments, the protease is co-localized with the target at a treatment site or diagnostic site in a subject. As used herein, co-localized refers to being at the same site or relatively close nearby. In some embodiments, a protease cleaves a CM yielding an activated antibody that binds to a target located nearby the cleavage site. The activatable antibodies disclosed herein find particular use where, for example, a protease capable of cleaving a site in the CM, i.e., a protease, is present at relatively higher levels in or in close proximity to target-containing tissue of a treatment site or diagnostic site than in tissue of non-treatment sites (for example in healthy tissue). In some embodiments, a CM of the disclosure is also cleaved by one or more other proteases. In some embodiments, it is the one or more other proteases that is co-localized with the target and that is responsible for cleavage of the CM in vivo.

In some embodiments activatable antibodies provide for reduced toxicity and/or adverse side effects that could otherwise result from binding of the AB at non-treatment sites if the AB were not masked or otherwise inhibited from binding to the target.

In general, an activatable antibody can be designed by selecting an AB of interest and constructing the remainder of the activatable antibody so that, when conformationally constrained, the MM provides for masking of the AB or reduction of binding of the AB to its target. Structural design criteria can be to be taken into account to provide for this functional feature.

Activatable antibodies exhibiting a switchable phenotype of a desired dynamic range for target binding in an inhibited versus an uninhibited conformation are provided. Dynamic range generally refers to a ratio of (a) a maximum detected level of a parameter under a first set of conditions to (b) a minimum detected value of that parameter under a second set of conditions. For example, in the context of an activatable antibody, the dynamic range refers to the ratio of (a) a maximum detected level of target protein binding to an activatable antibody in the presence of at least one protease capable of cleaving the CM of the activatable antibodies to (b) a minimum detected level of target protein binding to an activatable antibody in the absence of the protease. The dynamic range of an activatable antibody can be calculated as the ratio of the dissociation constant of an activatable antibody cleaving agent (e.g., enzyme) treatment to the dissociation constant of the activatable antibodies cleaving agent treatment. The greater the dynamic range of an activatable antibody, the better the switchable phenotype of the activatable antibody. Activatable antibodies having relatively higher dynamic range values (e.g., greater than 1) exhibit more desirable switching phenotypes such that target protein binding by the activatable antibodies occurs to a greater extent (e.g., predominantly occurs) in the presence of a cleaving agent (e.g., enzyme) capable of cleaving the CM of the activatable antibodies than in the absence of a cleaving agent.

Activatable antibodies can be provided in a variety of structural configurations. Exemplary formulae for activatable antibodies are provided below. It is specifically contemplated that the N- to C-terminal order of the AB, MM and CM can be reversed within an activatable antibody. It is also specifically contemplated that the CM and MM can overlap in amino acid sequence, e.g., such that the CM is contained within the MM.

For example, activatable antibodies can be represented by the following formula (in order from an amino (N) terminal region to carboxyl (C) terminal region:

(MM)-(CM)-(AB)

(AB)-(CM)-(MM)

where MM is a masking moiety, CM is a cleavable moiety, and AB is an antibody or fragment thereof. It should be noted that although MM and CM are indicated as distinct components in the formulae above, in all exemplary embodiments (including formulae) disclosed herein it is contemplated that the amino acid sequences of the MM and the CM could overlap, e.g., such that the CM is completely or partially contained within the MM. In addition, the formulae above provide for additional amino acid sequences that can be positioned N-terminal or C-terminal to the activatable antibodies elements.

In certain embodiments, the MM is not a natural binding partner of the AB. In some embodiments, the MM contains no or substantially no homology to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% similar to any natural binding partner of the AB. In some embodiments, the MM is no more than 5%, 10%, 15%, 20%, 25%, 30%, 35%, 40%, 45%, 50%, 55%, 60%, 65%, 70%, 75%, or 80% identical to any natural binding partner of the AB. In some embodiments, the MM is no more than 50% identical to any natural binding partner of the AB. In some embodiments, the MM is no more than 25% identical to any natural binding partner of the AB. In some embodiments, the MM is no more than 20% identical to any natural binding partner of the AB. In some embodiments, the MM is no more than 10% identical to any natural binding partner of the AB.

In many embodiments it can be desirable to insert one or more linkers, e.g., flexible linkers, into the activatable antibody construct so as to provide for flexibility at one or more of the MM-CM junction, the CM-AB junction, or both. For example, the AB, MM, and/or CM may not contain a sufficient number of residues (e.g., Gly, Ser, Asp, Asn, especially Gly and Ser, particularly Gly) to provide the desired flexibility. As such, the switchable phenotype of such activatable antibody constructs can benefit from introduction of one or more amino acids to provide for a flexible linker. In addition, as described below, where the activatable antibody is provided as a conformationally constrained construct, a flexible linker can be operably inserted to facilitate formation and maintenance of a cyclic structure in the uncleaved activatable antibody.

For example, in certain embodiments an activatable antibody comprises one of the following formulae (where the formula below represent an amino acid sequence in either N- to C-terminal direction or C- to N-terminal direction):

(MM)-L1-(CM)-(AB)

(MM)-(CM)-L2-(AB)

(MM)-L1-(CM)-L2-(AB)

wherein MM, CM, and AB are as defined above; wherein L1 and L2 are each independently and optionally present or absent, are the same or different flexible linkers that include at least 1 flexible amino acid (e.g., Gly). In addition, the formulae above provide for additional amino acid sequences that can be positioned N-terminal or C-terminal to the activatable antibodies elements. Examples include, but are not limited to, targeting moieties (e.g., a ligand for a receptor of a cell present in a target tissue) and serum half-life extending moieties (e.g., polypeptides that bind serum proteins, such as immunoglobulin (e.g., IgG) or serum albumin (e.g., human serum albumin (HAS)).

The CM is specifically cleaved by at least one protease at a rate of about 0.001-1500×$10^4$ $M^{-1}S^{-1}$ or at least 0.001, 0.005, 0.01, 0.05, 0.1, 0.5, 1, 2.5, 5, 7.5, 10, 15, 20, 25, 50, 75, 100, 125, 150, 200, 250, 500, 750, 1000, 1250, or 1500×$10^4$ $M^{-1}S^{-1}$. In some embodiments, the CM is specifically cleaved at a rate of about 100,000 $M^{-1}S^{-1}$. In some embodiments, the CM is specifically cleaved at a rate from about 1x10E2 to about 1x10E6 $M^{-1}S^{-1}$ (i.e., from about 1×$10^2$ to about 1×$10^6$ $M^{-1}S^{-1}$).

For specific cleavage by an enzyme, contact between the enzyme and CM is made. When the activatable antibody comprising an AB coupled to a MM and a CM is in the presence of target and sufficient enzyme activity, the CM can be cleaved. Sufficient enzyme activity can refer to the ability of the enzyme to make contact with the CM and effect cleavage. It can readily be envisioned that an enzyme can be in the vicinity of the CM but unable to cleave because of other cellular factors or protein modification of the enzyme.

Linkers suitable for use in compositions described herein are generally ones that provide flexibility of the modified AB or the activatable antibodies to facilitate the inhibition of the binding of the AB to the target. Such linkers are generally referred to as flexible linkers. Suitable linkers can be readily selected and can be of any of a suitable of different lengths, such as from 1 amino acid (e.g., Gly) to 20 amino acids, from 2 amino acids to 15 amino acids, from 3 amino acids to 12 amino acids, including 4 amino acids to 10 amino acids, 5 amino acids to 9 amino acids, 6 amino acids to 8 amino acids, or 7 amino acids to 8 amino acids, and can be 1, 2, 3, 4, 5, 6, 7, 8, 9, 10, 11, 12, 13, 14, 15, 16, 17, 18, 19, or 20 amino acids in length.

Exemplary flexible linkers include glycine polymers (G)n, glycine-serine polymers (including, for example, (GS)n, (GSGGS)n (SEQ ID NO: 363) and (GGGS)n (SEQ ID NO: 364), where n is an integer of at least one), glycine-alanine polymers, alanine-serine polymers, and other flexible linkers known in the art. Glycine and glycine-serine polymers are relatively unstructured, and therefore can be able to serve as a neutral tether between components. Glycine accesses significantly more phi-psi space than even alanine, and is much less restricted than residues with longer side chains (see Scheraga, Rev. Computational Chem. 11173-142 (1992)). Exemplary flexible linkers include, but are not limited to GGSG (SEQ ID NO: 365), GGSGG (SEQ ID NO: 366), GSGSG (SEQ ID NO: 367), GSGGG (SEQ ID NO: 368), GGGSG (SEQ ID NO: 369), GSSSG (SEQ ID NO: 370), and the like. The ordinarily skilled artisan will recognize that design of an activatable antibodies can include linkers that are all or partially flexible, such that the linker can include a flexible linker as well as one or more portions that confer less flexible structure to provide for a desired activatable antibodies structure.

The disclosure also provides compositions and methods that include an activatable anti-PD-1 antibody that includes an antibody or antibody fragment (AB) that specifically binds PD-1, where the AB is coupled to a masking moiety (MM) that decreases the ability of the AB to bind its target. In some embodiments, the activatable anti-PD-1 antibody further includes a cleavable moiety (CM) that is a substrate for a protease. The compositions and methods provided herein enable the attachment of one or more agents to one or more cysteine residues in the AB without compromising the activity (e.g., the masking, activating or binding activity) of the activatable anti-PD-1 antibody. In some embodiments, the compositions and methods provided herein enable the attachment of one or more agents to one or more cysteine residues in the AB without reducing or otherwise disturbing one or more disulfide bonds within the MM. The compositions and methods provided herein produce an activatable anti-PD-1 antibody that is conjugated to one or more agents, e.g., any of a variety of therapeutic, diagnostic and/or prophylactic agents, for example, in some embodiments, without any of the agent(s) being conjugated to the MM of the activatable anti-PD-1 antibody. The compositions and methods provided herein produce conjugated activatable anti-PD-1 antibodies in which the MM retains the ability to effectively and efficiently mask the AB of the activatable antibody in an uncleaved state. The compositions and methods provided herein produce conjugated activatable anti-PD-1 antibodies in which the activatable antibody is still activated, i.e., cleaved, in the presence of a protease that can cleave the CM.

The activatable anti-PD-1 antibodies have at least one point of conjugation for an agent, but in the methods and compositions provided herein less than all possible points of conjugation are available for conjugation to an agent. In some embodiments, the one or more points of conjugation are sulfur atoms involved in disulfide bonds. In some embodiments, the one or more points of conjugation are sulfur atoms involved in interchain disulfide bonds. In some embodiments, the one or more points of conjugation are sulfur atoms involved in interchain sulfide bonds, but not sulfur atoms involved in intrachain disulfide bonds. In some embodiments, the one or more points of conjugation are sulfur atoms of cysteine or other amino acid residues containing a sulfur atom. Such residues can occur naturally in the antibody structure or can be incorporated into the antibody by site-directed mutagenesis, chemical conversion, or mis-incorporation of non-natural amino acids.

Also provided are methods of preparing a conjugate of an activatable anti-PD-1 antibody having one or more interchain disulfide bonds in the AB and one or more intrachain disulfide bonds in the MM, and a drug reactive with free thiols is provided. The method generally includes partially reducing interchain disulfide bonds in the activatable antibody with a reducing agent, such as, for example, TCEP; and conjugating the drug reactive with free thiols to the partially reduced activatable antibody. As used herein, the term partial reduction refers to situations where an activatable anti-PD-1 antibody is contacted with a reducing agent and less than all disulfide bonds, e.g., less than all possible sites of conjugation are reduced. In some embodiments, less than 99%, 98%, 97%, 96%, 95%, 90%, 85%, 80%, 75%, 70%, 65%, 60%, 55%, 50%, 45%, 40%, 35%, 30%, 25%, 20%, 15%, 10% or less than 5% of all possible sites of conjugation are reduced.

In yet other embodiments, a method of reducing and conjugating an agent, e.g., a drug, to an activatable anti-PD-1 antibody resulting in selectivity in the placement of the agent is provided. The method generally includes partially reducing the activatable anti-PD-1 antibody with a reducing agent such that any conjugation sites in the masking moiety or other non-AB portion of the activatable antibody are not reduced, and conjugating the agent to interchain thiols in the AB. The conjugation site(s) are selected so as to allow desired placement of an agent to allow conjugation to occur at a desired site. The reducing agent is, for example, TCEP. The reduction reaction conditions such as, for example, the ratio of reducing agent to activatable antibody, the length of incubation, the temperature during the incubation, the pH of the reducing reaction solution, etc., are determined by identifying the conditions that produce a conjugated activatable antibody in which the MM retains the ability to effectively and efficiently mask the AB of the activatable antibody in an uncleaved state. The ratio of reduction agent to activatable anti-PD-1 antibody will vary depending on the activatable antibody. In some embodiments, the ratio of reducing agent to activatable anti-PD-1 antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

In some embodiments, a method of reducing interchain disulfide bonds in the AB of an activatable anti-PD-1 antibody and conjugating an agent, e.g., a thiol-containing agent such as a drug, to the resulting interchain thiols to selectively locate agent(s) on the AB is provided. The method generally includes partially reducing the AB with a reducing agent to form at least two interchain thiols without forming all possible interchain thiols in the activatable antibody; and conjugating the agent to the interchain thiols of the partially reduced AB. For example, the AB of the activatable antibody is partially reduced for about 1 hour at about 37° C. at a desired ratio of reducing agent:activatable antibody. In some embodiments, the ratio of reducing agent to activatable antibody will be in a range from about 20:1 to 1:1, from about 10:1 to 1:1, from about 9:1 to 1:1, from about 8:1 to 1:1, from about 7:1 to 1:1, from about 6:1 to 1:1, from about 5:1 to 1:1, from about 4:1 to 1:1, from about 3:1 to 1:1, from about 2:1 to 1:1, from about 20:1 to 1:1.5, from about 10:1 to 1:1.5, from about 9:1 to 1:1.5, from about 8:1 to 1:1.5, from about 7:1 to 1:1.5, from about 6:1 to 1:1.5, from about 5:1 to 1:1.5, from about 4:1 to 1:1.5, from about 3:1 to 1:1.5, from about 2:1 to 1:1.5, from about 1.5:1 to 1:1.5, or from about 1:1 to 1:1.5. In some embodiments, the ratio is in a range of from about 5:1 to 1:1. In some embodiments, the ratio is in a range of from about 5:1 to 1.5:1. In some embodiments, the ratio is in a range of from about 4:1 to 1:1. In some embodiments, the ratio is in a range from about 4:1 to 1.5:1. In some embodiments, the ratio is in a range from about 8:1 to about 1:1. In some embodiments, the ratio is in a range of from about 2.5:1 to 1:1.

The thiol-containing reagent can be, for example, cysteine or N-acetyl cysteine. The reducing agent can be, for example, TCEP. In some embodiments, the reduced activatable antibody can be purified prior to conjugation, using for example, column chromatography, dialysis, or diafiltration. Alternatively, the reduced antibody is not purified after partial reduction and prior to conjugation.

The invention also provides partially reduced activatable anti-PD-1 antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to PD-1, a masking moiety (MM) that inhibits the binding of the AB of the activatable antibody in an uncleaved state to the PD-1 target, and a cleavable moiety (CM) coupled to the AB, wherein the CM is a polypeptide that functions as a substrate for a protease. In some embodiments the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: MM-CM-AB or AB-CM-MM. In some embodiments, reducing agent is TCEP.

The disclosure also provides partially reduced activatable antibodies in which at least one interchain disulfide bond in the activatable antibody has been reduced with a reducing agent without disturbing any intrachain disulfide bonds in the activatable antibody, wherein the activatable antibody includes an antibody or an antigen binding fragment thereof (AB) that specifically binds to the target, e.g., PD-1, a masking moiety (MM) that inhibits the binding of the AB of the activatable antibody in an uncleaved state to the target, and a cleavable moiety (CM) coupled to the AB, wherein the CM is a polypeptide that functions as a substrate for at least one protease. In some embodiments, the MM is coupled to the AB via the CM. In some embodiments, one or more intrachain disulfide bond(s) of the activatable antibody is not disturbed by the reducing agent. In some embodiments, one or more intrachain disulfide bond(s) of the MM within the activatable antibody is not disturbed by the reducing agent. In some embodiments, the activatable antibody in the uncleaved state has the structural arrangement from N-terminus to C-terminus as follows: MM-CM-AB or AB-CM-MM. In some embodiments, reducing agent is TCEP.

In some embodiments, the activatable antibodies described herein also include an agent conjugated to the activatable antibody. In some embodiments, the conjugated agent is a therapeutic agent, such as an anti-inflammatory. In such embodiments, the agent is conjugated to a carbohydrate moiety of the activatable antibody, for example, in some embodiments, where the carbohydrate moiety is located outside the antigen-binding region of the antibody or antigen-binding fragment in the activatable antibody. In some embodiments, the agent is conjugated to a sulfhydryl group of the antibody or antigen-binding fragment in the activatable antibody.

In some embodiments, the agent is a detectable moiety such as, for example, a label or other marker. For example, the agent is or includes a radiolabeled amino acid, one or more biotinyl moieties that can be detected by marked avidin (e.g., streptavidin containing a fluorescent marker or enzymatic activity that can be detected by optical or calorimetric methods), one or more radioisotopes or radionuclides, one or more fluorescent labels, one or more enzymatic labels, and/or one or more chemiluminescent agents. In some embodiments, detectable moieties are attached by spacer molecules.

Those of ordinary skill in the art will recognize that a large variety of possible moieties can be coupled to the resultant antibodies of the disclosure. (See, for example, "Conjugate Vaccines", Contributions to Microbiology and Immunology, J. M. Cruse and R. E. Lewis, Jr (eds), Carger Press, New York, (1989), the entire contents of which are incorporated herein by reference).

Coupling can be accomplished by any chemical reaction that will bind the two molecules so long as the antibody and the other moiety retain their respective activities. This linkage can include many chemical mechanisms, for instance covalent binding, affinity binding, intercalation, coordinate binding and complexation. In some embodiments, the binding is, however, covalent binding. Covalent binding can be achieved either by direct condensation of existing side chains or by the incorporation of external bridging molecules. Many bivalent or polyvalent linking agents are useful in coupling protein molecules, such as the antibodies of the present disclosure, to other molecules. For example, representative coupling agents can include organic compounds such as thioesters, carbodiimides, succinimide esters, diisocyanates, glutaraldehyde, diazobenzenes and hexamethylene diamines. This listing is not intended to be exhaustive of the various classes of coupling agents known in the art but, rather, is exemplary of the more common coupling agents. (See Killen and Lindstrom, Jour. Immun. 133:1335-2549 (1984); Jansen et al., Immunological Reviews 62:185-216 (1982); and Vitetta et al., Science 238:1098 (1987).

In some embodiments, in addition to the compositions and methods provided herein, the conjugated activatable antibody can also be modified for site-specific conjugation through modified amino acid sequences inserted or otherwise included in the activatable antibody sequence. These modified amino acid sequences are designed to allow for controlled placement and/or dosage of the conjugated agent within a conjugated activatable antibody. For example, the activatable antibody can be engineered to include cysteine substitutions at positions on light and heavy chains that provide reactive thiol groups and do not negatively impact protein folding and assembly, nor alter antigen binding. In some embodiments, the activatable antibody can be engineered to include or otherwise introduce one or more non-natural amino acid residues within the activatable antibody to provide suitable sites for conjugation. In some embodiments, the activatable antibody can be engineered to include or otherwise introduce enzymatically activatable peptide sequences within the activatable antibody sequence.

Suitable linkers are described in the literature. (See, for example, Ramakrishnan, S. et al., Cancer Res. 44:201-208 (1984) describing use of MBS (M-maleimidobenzoyl-N-hydroxysuccinimide ester). See also, U.S. Pat. No. 5,030,719, describing use of halogenated acetyl hydrazide derivative coupled to an antibody by way of an oligopeptide linker. In some embodiments, suitable linkers include: (i) EDC (1-ethyl-3-(3-dimethylamino-propyl) carbodiimide hydrochloride; (ii) SMPT (4-succinimidyloxycarbonyl-alpha-methyl-alpha-(2-pridyl-dithio)-toluene (Pierce Chem. Co., Cat. (21558G); (iii) SPDP (succinimidyl-6 [3-(2-pyridyldithio) propionamido]hexanoate (Pierce Chem. Co., Cat #21651G); (iv) Sulfo-LC-SPDP (sulfosuccinimidyl 6 [3-(2-pyridyldithio)-propianamide] hexanoate (Pierce Chem. Co. Cat. #2165-G); and (v) sulfo-NHS (N-hydroxysulfo-succinimide: Pierce Chem. Co., Cat. #24510) conjugated to EDC. Additional linkers include, but are not limited to, SMCC, sulfo-SMCC, SPDB, or sulfo-SPDB.

The linkers described above contain components that have different attributes, thus leading to conjugates with differing physio-chemical properties. For example, sulfo-NHS esters of alkyl carboxylates are more stable than sulfo-NHS esters of aromatic carboxylates. NHS-ester containing linkers are less soluble than sulfo-NHS esters. Further, the linker SMPT contains a sterically hindered disulfide bond, and can form conjugates with increased stability. Disulfide linkages, are in general, less stable than other linkages because the disulfide linkage is cleaved in vitro, resulting in less conjugate available. Sulfo-NHS, in particular, can enhance the stability of carbodimide couplings. Carbodimide couplings (such as EDC) when used in conjunction with sulfo-NHS, forms esters that are more resistant to hydrolysis than the carbodimide coupling reaction alone.

In some embodiments, the linkers are cleavable. In some embodiments, the linkers are non-cleavable. In some embodiments, two or more linkers are present. The two or more linkers are all the same, i.e., cleavable or non-cleavable, or the two or more linkers are different, i.e., at least one cleavable and at least one non-cleavable.

The present disclosure utilizes several methods for attaching agents to ABs: (a) attachment to the carbohydrate moieties of the AB, or (b) attachment to sulfhydryl groups of the AB, or (c) attachment to amino groups of the AB, or (d) attachment to carboxylate groups of the AB. According to the disclosure, ABs can be covalently attached to an agent through an intermediate linker having at least two reactive groups, one to react with AB and one to react with the agent. The linker, which can include any compatible organic compound, can be chosen such that the reaction with AB (or agent) does not adversely affect AB reactivity and selectivity. Furthermore, the attachment of linker to agent might not destroy the activity of the agent. Suitable linkers for reaction with oxidized antibodies or oxidized antibody fragments include those containing an amine selected from the group consisting of primary amine, secondary amine, hydrazine, hydrazide, hydroxylamine, phenylhydrazine, semicarbazide and thiosemicarbazide groups. Such reactive functional groups can exist as part of the structure of the linker, or can be introduced by suitable chemical modification of linkers not containing such groups.

According to the present disclosure, suitable linkers for attachment to reduced ABs include those having certain reactive groups capable of reaction with a sulfhydryl group of a reduced antibody or fragment. Such reactive groups include, but are not limited to: reactive haloalkyl groups (including, for example, haloacetyl groups), p-mercuribenzoate groups and groups capable of Michael-type addition reactions (including, for example, maleimides and groups of the type described by Mitra and Lawton, 1979, J. Amer. Chem. Soc. 101: 3097-3110).

According to the present disclosure, suitable linkers for attachment to neither oxidized nor reduced Abs include those having certain functional groups capable of reaction with the primary amino groups present in unmodified lysine residues in the Ab. Such reactive groups include, but are not limited to, NHS carboxylic or carbonic esters, sulfo-NHS carboxylic or carbonic esters, 4-nitrophenyl carboxylic or carbonic esters, pentafluorophenyl carboxylic or carbonic esters, acyl imidazoles, isocyanates, and isothiocyanates.

According to the present disclosure, suitable linkers for attachment to neither oxidized nor reduced Abs include those having certain functional groups capable of reaction with the carboxylic acid groups present in aspartate or glutamate residues in the Ab, which have been activated with suitable reagents. Suitable activating reagents include EDC, with or without added NHS or sulfo-NHS, and other dehydrating agents utilized for carboxamide formation. In these instances, the functional groups present in the suitable linkers would include primary and secondary amines, hydrazines, hydroxylamines, and hydrazides.

The agent can be attached to the linker before or after the linker is attached to the AB. In certain applications it can be desirable to first produce an AB-linker intermediate in which the linker is free of an associated agent. Depending upon the particular application, a specific agent can then be covalently attached to the linker. In some embodiments, the AB is first attached to the MM, CM and associated linkers and then attached to the linker for conjugation purposes.

Branched Linkers:

In specific embodiments, branched linkers that have multiple sites for attachment of agents are utilized. For multiple site linkers, a single covalent attachment to an AB would result in an AB-linker intermediate capable of binding an agent at a number of sites. The sites can be aldehyde or sulfhydryl groups or any chemical site to which agents can be attached.

In some embodiments, higher specific activity (or higher ratio of agents to AB) can be achieved by attachment of a single site linker at a plurality of sites on the AB. This plurality of sites can be introduced into the AB by either of two methods. First, one can generate multiple aldehyde groups and/or sulfhydryl groups in the same AB. Second, one can attach to an aldehyde or sulfhydryl of the AB a "branched linker" having multiple functional sites for subsequent attachment to linkers. The functional sites of the branched linker or multiple site linker can be aldehyde or sulfhydryl groups, or can be any chemical site to which linkers can be attached. Still higher specific activities can be obtained by combining these two approaches, that is, attaching multiple site linkers at several sites on the AB.

Cleavable Linkers:

Peptide linkers that are susceptible to cleavage by enzymes of the complement system, such as but not limited to u-plasminogen activator, tissue plasminogen activator, trypsin, plasmin, or another enzyme having proteolytic activity can be used in one embodiment of the present disclosure. According to one method of the present disclosure, an agent is attached via a linker susceptible to cleavage by complement. The antibody is selected from a class that can activate complement. The antibody-agent conjugate, thus, activates the complement cascade and releases the agent at the target site. According to another method of the present disclosure, an agent is attached via a linker susceptible to cleavage by enzymes having a proteolytic activity such as a u-plasminogen activator, a tissue plasminogen activator, plasmin, or trypsin.

Non-limiting examples of cleavable linker sequences are provided in Table 5.

would modify a CM would also modify the linker of the conjugated activatable antibody.

Spacers and Cleavable Elements:

In some embodiments, it can be necessary to construct the linker in such a way as to optimize the spacing between the agent and the AB of the activatable antibody. This can be accomplished by use of a linker of the general structure:

$$W—(CH_2)n-Q$$

wherein
W is either $—NH—CH_2—$ or $—CH_2—$;
Q is an amino acid, peptide; and
n is an integer from 0 to 20.

TABLE 5

Exemplary Linker Sequences for Conjugation

| Types of Cleavable Sequences | Amino Acid Sequence |
|---|---|
| Plasmin cleavable sequences | |
| Pro-urokinase | PRFKIIGG (SEQ ID NO: 587) |
|  | PRFRIIGG (SEQ ID NO: 588) |
| TGFβ | SSRHRRALD (SEQ ID NO: 589) |
| Plasminogen | RKSSIIIRMRDVVL (SEQ ID NO: 590) |
| Staphylokinase | SSSFDKGKYKKGDDA (SEQ ID NO: 591) |
|  | SSSFDKGKYKRGDDA (SEQ ID NO: 592) |
| Factor Xa cleavable sequences | IEGR (SEQ ID NO: 593) |
|  | IDGR (SEQ ID NO: 594) |
|  | GGSIDGR (SEQ ID NO: 595) |
| MMP cleavable sequences | |
| Gelatinase A | PLGLWA (SEQ ID NO: 596) |
| Collagenase cleavable sequences | |
| Calf skin collagen (α1(I) chain) | GPQGIAGQ (SEQ ID NO: 597) |
| Calf skin collagen (α2(I) chain) | GPQGLLGA (SEQ ID NO: 598) |
| Bovine cartilage collagen (α1(II) chain) | GIAGQ (SEQ ID NO: 599) |
| Human liver collagen (α1(III) chain) | GPLGIAGI (SEQ ID NO: 600) |
| Human α$_2$M | GPEGLRVG (SEQ ID NO: 601) |
| Human PZP | YGAGLGVV (SEQ ID NO: 602) |
|  | AGLGVVER (SEQ ID NO: 603) |
|  | AGLGISST (SEQ ID NO: 604) |
| Rat α$_1$M | EPQALAMS (SEQ ID NO: 605) |
|  | QALAMSAI (SEQ ID NO: 606) |
| Rat α$_2$M | AAYHLVSQ (SEQ ID NO: 607) |
|  | MDAFLESS (SEQ ID NO: 608) |
| Rat α$_1$I$_3$(2J) | ESLPVVAV (SEQ ID NO: 609) |
| Rat α$_1$I$_3$(27J) | SAPAVESE (SEQ ID NO: 610) |
| Human fibroblast collagenase (autolytic cleavages) | DVAQFVLT (SEQ ID NO: 611) |
|  | VAQFVLTE (SEQ ID NO: 612) |
|  | AQFVLTEG (SEQ ID NO: 613) |
|  | PVQPIGPQ (SEQ ID NO: 614) |

In addition, agents can be attached via disulfide bonds (for example, the disulfide bonds on a cysteine molecule) to the AB. Since many tumors naturally release high levels of glutathione (a reducing agent) this can reduce the disulfide bonds with subsequent release of the agent at the site of delivery. In some embodiments, the reducing agent that In some embodiments, the linker can comprise a spacer element and a cleavable element. The spacer element serves to position the cleavable element away from the core of the AB such that the cleavable element is more accessible to the enzyme responsible for cleavage. Certain of the branched linkers described above can serve as spacer elements.

Throughout this discussion, it should be understood that the attachment of linker to agent (or of spacer element to cleavable element, or cleavable element to agent) need not be particular mode of attachment or reaction. Any reaction providing a product of suitable stability and biological compatibility is acceptable.

Serum Complement and Selection of Linkers:

According to one method of the present disclosure, when release of an agent is desired, an AB that is an antibody of a class that can activate complement is used. The resulting conjugate retains both the ability to bind antigen and activate the complement cascade. Thus, according to this embodiment of the present disclosure, an agent is joined to one end of the cleavable linker or cleavable element and the other end of the linker group is attached to a specific site on the AB. For example, if the agent has an hydroxy group or an amino group, it can be attached to the carboxy terminus of a peptide, amino acid or other suitably chosen linker via an ester or amide bond, respectively. For example, such agents can be attached to the linker peptide via a carbodimide reaction. If the agent contains functional groups that would interfere with attachment to the linker, these interfering functional groups can be blocked before attachment and deblocked once the product conjugate or intermediate is made. The opposite or amino terminus of the linker is then used either directly or after further modification for binding to an AB that is capable of activating complement.

Linkers (or spacer elements of linkers) can be of any desired length, one end of which can be covalently attached to specific sites on the AB of the activatable antibody. The other end of the linker or spacer element can be attached to an amino acid or peptide linker.

Thus when these conjugates bind to antigen in the presence of complement the amide or ester bond that attaches the agent to the linker will be cleaved, resulting in release of the agent in its active form. These conjugates, when administered to a subject, will accomplish delivery and release of the agent at the target site, and are particularly effective for the in vivo delivery of pharmaceutical agents, antibiotics, antimetabolites, antiproliferative agents and the like as presented in but not limited to those in Table 5.

Linkers for Release without Complement Activation:

In yet another application of targeted delivery, release of the agent without complement activation is desired since activation of the complement cascade will ultimately lyse the target cell. Hence, this approach is useful when delivery and release of the agent should be accomplished without killing the target cell. Such is the goal when delivery of cell mediators such as hormones, enzymes, corticosteroids, neurotransmitters, genes or enzymes to target cells is desired. These conjugates can be prepared by attaching the agent to an AB that is not capable of activating complement via a linker that is mildly susceptible to cleavage by serum proteases. When this conjugate is administered to an individual, antigen-antibody complexes will form quickly whereas cleavage of the agent will occur slowly, thus resulting in release of the compound at the target site.

Biochemical Cross Linkers:

In some embodiments, the activatable antibody can be conjugated to one or more therapeutic agents using certain biochemical cross-linkers. Cross-linking reagents form molecular bridges that tie together functional groups of two different molecules. To link two different proteins in a step-wise manner, hetero-bifunctional cross-linkers can be used that eliminate unwanted homopolymer formation.

Peptidyl linkers cleavable by lysosomal proteases are also useful, for example, Val-Cit, Val-Ala or other dipeptides. In addition, acid-labile linkers cleavable in the low-pH environment of the lysosome can be used, for example: bis-sialyl ether. Other suitable linkers include cathepsin-labile substrates, particularly those that show optimal function at an acidic pH.

Exemplary hetero-bifunctional cross-linkers are referenced in Table 6.

TABLE 6

Exemplary Hetero-Bifunctional Cross Linkers
HETERO-BIFUNCTIONAL CROSS-LINKERS

| Linker | Reactive Toward | Advantages and Applications | Spacer Arm Length after cross-linking (Angstroms) |
|---|---|---|---|
| SMPT | Primary amines Sulfhydryls | Greater stability | 11.2 Å |
| SPDP | Primary amines Sulfhydryls | Thiolation Cleavable cross-linking | 6.8 Å |
| LC-SPDP | Primary amines Sulfhydryls | Extended spacer arm | 15.6 Å |
| Sulfo-LC-SPDP | Primary amines Sulfhydryls | Extender spacer arm Water-soluble | 15.6 Å |
| SMCC | Primary amines Sulfhydryls | Stable maleimide reactive group Enzyme-antibody conjugation Hapten-carrier protein conjugation | 11.6 Å |
| Sulfo-SMCC | Primary amines Sulfhydryls | Stable maleimide reactive group Water-soluble Enzyme-antibody conjugation | 11.6 Å |
| MBS | Primary amines Sulfhydryls | Enzyme-antibody conjugation Hapten-carrier protein conjugation | 9.9 Å |
| Sulfo-MBS | Primary amines Sulfhydryls | Water-soluble | 9.9 Å |
| SIAB | Primary amines Sulfhydryls | Enzyme-antibody conjugation | 10.6 Å |
| Sulfo-SIAB | Primary amines Sulfhydryls | Water-soluble | 10.6 Å |
| SMPB | Primary amines Sulfhydryls | Extended spacer arm Enzyme-antibody conjugation | 14.5 Å |
| Sulfo-SMPB | Primary amines Sulfhydryls | Extended spacer arm Water-soluble | 14.5 Å |
| EDE/Sulfo-NHS | Primary amines Carboxyl groups | Hapten-Carrier conjugation | 0 |
| ABH | Carbohydrates Nonselective | Reacts with sugar groups | 11.9 Å |

Non-Cleavable Linkers or Direct Attachment:

In some embodiments of the disclosure, the conjugate can be designed so that the agent is delivered to the target but not released. This can be accomplished by attaching an agent to an AB either directly or via a non-cleavable linker.

These non-cleavable linkers can include amino acids, peptides, D-amino acids or other organic compounds that can be modified to include functional groups that can subsequently be utilized in attachment to ABs by the methods described herein. A-general formula for such an organic linker could be

wherein

W is either —NH—CH$_2$— or —CH$_2$—;

Q is an amino acid, peptide; and n is an integer from 0 to 20.

Non-Cleavable Conjugates:

In some embodiments, a compound can be attached to ABs that do not activate complement. When using ABs that are incapable of complement activation, this attachment can be accomplished using linkers that are susceptible to cleavage by activated complement or using linkers that are not susceptible to cleavage by activated complement.

The antibodies disclosed herein can also be formulated as immunoliposomes. Liposomes containing the antibody are prepared by methods known in the art, such as described in Epstein et al., Proc. Natl. Acad. Sci. USA, 82: 3688 (1985); Hwang et al., Proc. Natl Acad. Sci. USA, 77: 4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse-phase evaporation method with a lipid composition comprising phosphatidylcholine, cholesterol, and PEG-derivatized phosphatidylethanolamine (PEG-PE). Liposomes are extruded through filters of defined pore size to yield liposomes with the desired diameter. Fab' fragments of the antibody of the present disclosure can be conjugated to the liposomes as described in Martin et al., J. Biol. Chem., 257: 286-288 (1982) via a disulfide-interchange reaction.

Definitions

Unless otherwise defined, scientific and technical terms used in connection with the present disclosure shall have the meanings that are commonly understood by those of ordinary skill in the art. The term "a" entity or "an" entity refers to one or more of that entity. For example, a compound refers to one or more compounds. As such, the terms "a", "an", "one or more" and "at least one" can be used interchangeably. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization described herein are those well-known and commonly used in the art. Standard techniques are used for recombinant DNA, oligonucleotide synthesis, and tissue culture and transformation (e.g., electroporation, lipofection). Enzymatic reactions and purification techniques are performed according to manufacturer's specifications or as commonly accomplished in the art or as described herein. The foregoing techniques and procedures are generally performed according to conventional methods well known in the art and as described in various general and more specific references that are cited and discussed throughout the present specification. See e.g., Sambrook et al. Molecular Cloning: A Laboratory Manual (2d ed., Cold Spring Harbor Laboratory Press, Cold Spring Harbor, N.Y. (1989)). The nomenclatures utilized in connection with, and the laboratory procedures and techniques of, analytical chemistry, synthetic organic chemistry, and medicinal and pharmaceutical chemistry described herein are those well-known and commonly used in the art. Standard techniques are used for chemical syntheses, chemical analyses, pharmaceutical preparation, formulation, and delivery, and treatment of patients.

As utilized in accordance with the present disclosure, the following terms, unless otherwise indicated, shall be understood to have the following meanings:

As used herein, the term "antibody" refers to immunoglobulin molecules and antigen-binding portions of immunoglobulin (Ig) molecules, i.e., molecules that contain an antigen binding site that specifically binds (immunoreacts with) an antigen. By "specifically bind" or "immunoreacts with" or "immunospecifically bind" is meant that the antibody reacts with one or more antigenic determinants of the desired antigen and does not react with other polypeptides or binds at much lower affinity ($K_d > 10^{-6}$). Antibodies include, but are not limited to, polyclonal, monoclonal, chimeric, domain antibody, single chain, Fab, and F(ab')$_2$ fragments, scFvs, and an Fab expression library.

The basic antibody structural unit is known to comprise a tetramer. Each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. In general, antibody molecules obtained from humans relate to any of the classes IgG, IgM, IgA, IgE and IgD, which differ from one another by the nature of the heavy chain present in the molecule. Certain classes have subclasses as well, such as IgG1, IgG$_2$, and others. Furthermore, in humans, the light chain can be a kappa chain or a lambda chain.

The term "monoclonal antibody" (mAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs contain an antigen binding site capable of immunoreacting with a particular epitope of the antigen characterized by a unique binding affinity for it.

The term "antigen-binding site" or "binding portion" refers to the part of the immunoglobulin molecule that participates in antigen binding. The antigen binding site is formed by amino acid residues of the N-terminal variable ("V") regions of the heavy ("H") and light ("L") chains. Three highly divergent stretches within the V regions of the heavy and light chains, referred to as "hypervariable regions," are interposed between more conserved flanking stretches known as "framework regions," or "FRs". Thus, the term "FR" refers to amino acid sequences that are naturally found between, and adjacent to, hypervariable regions in immunoglobulins. In an antibody molecule, the three hypervariable regions of a light chain and the three hypervariable regions of a heavy chain are disposed relative to each other in three dimensional space to form an antigen-binding surface. The antigen-binding surface is complementary to the three-dimensional surface of a bound antigen, and the three hypervariable regions of each of the heavy and light chains are referred to as "complementarity-determining regions," or "CDRs." The assignment of amino acids to each domain is in accordance with the definitions of Kabat Sequences of Proteins of Immunological Interest (National Institutes of Health, Bethesda, Md. (1987 and 1991)), or Chothia & Lesk J. Mol. Biol. 196:901-917 (1987), Chothia et al. Nature 342:878-883 (1989).

As used herein, the term "epitope" includes any protein determinant capable of specific binding to an immunoglobulin, an scFv, or a T-cell receptor. The term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. For example, antibodies can be raised against N-terminal or C-terminal peptides of a polypeptide. An antibody is said to specifically bind an antigen when the dissociation constant is ≤1 µM; in some embodiments, ≤100 nM and in some embodiments, ≤10 nM.

As used herein, the terms "specific binding," "immunological binding," and "immunological binding properties" refer to the non-covalent interactions of the type which occur between an immunoglobulin molecule and an antigen for which the immunoglobulin is specific. The strength, or affinity of immunological binding interactions can be expressed in terms of the dissociation constant ($K_d$) of the interaction, wherein a smaller $K_d$ represents a greater affinity. Immunological binding properties of selected polypeptides can be quantified using methods well known in the art. One such method entails measuring the rates of antigen-binding site/antigen complex formation and dissociation, wherein those rates depend on the concentrations of the complex partners, the affinity of the interaction, and geometric parameters that equally influence the rate in both directions. Thus, both the "on rate constant" ($K_{on}$) and the "off rate constant" ($K_{off}$) can be determined by calculation of the concentrations and the actual rates of association and dissociation. (See Nature 361:186-87 (1993)). The ratio of $K_{off}/K_{on}$ is equal to the dissociation constant $K_d$. (See, generally, Davies et al. (1990) Annual Rev Biochem 59:439-473). An antibody of the present disclosure is said to specifically bind to the target, when the binding constant ($K_d$) is ≤1 µM, in some embodiments ≤100 nM, in some embodiments ≤10 nM, and in some embodiments ≤100 pM to about 1 pM, as measured by assays such as radioligand binding assays or similar assays known to those skilled in the art.

The term "isolated polynucleotide" as used herein shall mean a polynucleotide of genomic, cDNA, or synthetic origin or some combination thereof, which by virtue of its origin the "isolated polynucleotide" (1) is not associated with all or a portion of a polynucleotide in which the "isolated polynucleotide" is found in nature, (2) is operably linked to a polynucleotide which it is not linked to in nature, or (3) does not occur in nature as part of a larger sequence. Polynucleotides in accordance with the disclosure include the nucleic acid molecules encoding the heavy chain immunoglobulin molecules shown herein, and nucleic acid molecules encoding the light chain immunoglobulin molecules shown herein.

The term "isolated protein" referred to herein means a protein of cDNA, recombinant RNA, or synthetic origin or some combination thereof, which by virtue of its origin, or source of derivation, the "isolated protein" (1) is not associated with proteins found in nature, (2) is free of other proteins from the same source, e.g., free of murine proteins, (3) is expressed by a cell from a different species, or (4) does not occur in nature.

The term "polypeptide" is used herein as a generic term to refer to native protein, fragments, or analogs of a polypeptide sequence. Hence, native protein fragments, and analogs are species of the polypeptide genus. Polypeptides in accordance with the disclosure comprise the heavy chain immunoglobulin molecules shown herein, and the light chain immunoglobulin molecules shown herein, as well as antibody molecules formed by combinations comprising the heavy chain immunoglobulin molecules with light chain immunoglobulin molecules, such as kappa light chain immunoglobulin molecules, and vice versa, as well as fragments and analogs thereof.

The term "naturally-occurring" as used herein as applied to an object refers to the fact that an object can be found in nature. For example, a polypeptide or polynucleotide sequence that is present in an organism (including viruses) that can be isolated from a source in nature and that has not been intentionally modified by man in the laboratory or otherwise is naturally-occurring.

The term "operably linked" as used herein refers to positions of components so described are in a relationship permitting them to function in their intended manner. A control sequence "operably linked" to a coding sequence is ligated in such a way that expression of the coding sequence is achieved under conditions compatible with the control sequences.

The term "control sequence" as used herein refers to polynucleotide sequences that are necessary to effect the expression and processing of coding sequences to which they are ligated. The nature of such control sequences differs depending upon the host organism in prokaryotes, such control sequences generally include promoter, ribosomal binding site, and transcription termination sequence in eukaryotes, generally, such control sequences include promoters and transcription termination sequence. The term "control sequences" is intended to include, at a minimum, all components whose presence is essential for expression and processing, and can also include additional components whose presence is advantageous, for example, leader sequences and fusion partner sequences. The term "polynucleotide" as referred to herein means nucleotides of at least 10 bases in length, either ribonucleotides or deoxynucleotides or a modified form of either type of nucleotide. The term includes single and double stranded forms of DNA.

The term oligonucleotide referred to herein includes naturally occurring, and modified nucleotides linked together by naturally occurring, and non-naturally occurring oligonucleotide linkages. Oligonucleotides are a polynucleotide subset generally comprising a length of 200 bases or fewer. In some embodiments, oligonucleotides are 10 to 60 bases in length and in some embodiments, 12, 13, 14, 15, 16, 17, 18, 19, or 20 to 40 bases in length. Oligonucleotides are usually single stranded, e.g., for probes, although oligonucleotides can be double stranded, e.g., for use in the construction of a gene mutant. Oligonucleotides of the disclosure are either sense or antisense oligonucleotides.

The term "naturally occurring nucleotides" referred to herein includes deoxyribonucleotides and ribonucleotides. The term "modified nucleotides" referred to herein includes nucleotides with modified or substituted sugar groups and the like. The term "oligonucleotide linkages" referred to herein includes oligonucleotide linkages such as phosphorothioate, phosphorodithioate, phosphoroselerloate, phosphorodiselenoate, phosphoroanilothioate, phoshoraniladate, phosphoronmidate, and the like. See e.g., LaPlanche et al. Nucl. Acids Res. 14:9081 (1986); Stec et al. J. Am. Chem. Soc. 106:6077 (1984), Stein et al. Nucl. Acids Res. 16:3209 (1988), Zon et al. Anti Cancer Drug Design 6:539 (1991); Zon et al. Oligonucleotides and Analogues: A Practical Approach, pp. 87-108 (F. Eckstein, Ed., Oxford University Press, Oxford England (1991)); Stec et al. U.S. Pat. No. 5,151,510; Uhlmann and Peyman Chemical Reviews 90:543 (1990). An oligonucleotide can include a label for detection, if desired.

As used herein, the twenty conventional amino acids and their abbreviations follow conventional usage. See Immunology—A Synthesis (2nd Edition, E. S. Golub and D. R. Green, Eds., Sinauer Associates, Sunderland, Mass. (1991)). Stereoisomers (e.g., D-amino acids) of the twenty conventional amino acids, unnatural amino acids such as α-, α-disubstituted amino acids, N-alkyl amino acids, lactic acid, and other unconventional amino acids can also be suitable components for polypeptides of the present disclosure. Examples of unconventional amino acids include: 4 hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxy-terminal direction, in accordance with standard usage and convention.

Similarly, unless specified otherwise, the left-hand end of single-stranded polynucleotide sequences is the 5' end the left-hand direction of double-stranded polynucleotide sequences is referred to as the 5' direction. The direction of 5' to 3' addition of nascent RNA transcripts is referred to as the transcription direction sequence regions on the DNA strand having the same sequence as the RNA and that are 5' to the 5' end of the RNA transcript are referred to as "upstream sequences", sequence regions on the DNA strand having the same sequence as the RNA and that are 3' to the 3' end of the RNA transcript are referred to as "downstream sequences".

As applied to polypeptides, the term "substantial identity" means that two peptide sequences, when optimally aligned, such as by the programs GAP or BESTFIT using default gap weights, share at least 80 percent sequence identity, in some embodiments, at least 90 percent sequence identity, in some embodiments, at least 95 percent sequence identity, and in some embodiments, at least 99 percent sequence identity.

In some embodiments, residue positions that are not identical differ by conservative amino acid substitutions.

As discussed herein, minor variations in the amino acid sequences of antibodies or immunoglobulin molecules are contemplated as being encompassed by the present disclosure, providing that the variations in the amino acid sequence maintain at least 75%, in some embodiments, at least 80%, 90%, 95%, and in some embodiments, 99%. In particular, conservative amino acid replacements are contemplated. Conservative replacements are those that take place within a family of amino acids that are related in their side chains. Genetically encoded amino acids are generally divided into families: (1) acidic amino acids are aspartate, glutamate; (2) basic amino acids are lysine, arginine, histidine; (3) non-polar amino acids are alanine, valine, leucine, isoleucine, proline, phenylalanine, methionine, tryptophan, and (4) uncharged polar amino acids are glycine, asparagine, glutamine, cysteine, serine, threonine, tyrosine. The hydrophilic amino acids include arginine, asparagine, aspartate, glutamine, glutamate, histidine, lysine, serine, and threonine. The hydrophobic amino acids include alanine, cysteine, isoleucine, leucine, methionine, phenylalanine, proline, tryptophan, tyrosine and valine. Other families of amino acids include (i) serine and threonine, which are the aliphatic-hydroxy family; (ii) asparagine and glutamine, which are the amide containing family; (iii) alanine, valine, leucine and isoleucine, which are the aliphatic family; and (iv) phenylalanine, tryptophan, and tyrosine, which are the aromatic family. For example, it is reasonable to expect that an isolated replacement of a leucine with an isoleucine or valine, an aspartate with a glutamate, a threonine with a serine, or a similar replacement of an amino acid with a structurally related amino acid will not have a major effect on the binding or properties of the resulting molecule, especially if the replacement does not involve an amino acid within a framework site. Whether an amino acid change results in a functional peptide can readily be determined by assaying the specific activity of the polypeptide derivative. Assays are described in detail herein. Fragments or analogs of antibodies or immunoglobulin molecules can be readily prepared by those of ordinary skill in the art. Suitable amino- and carboxy-termini of fragments or analogs occur near boundaries of functional domains. Structural and functional domains can be identified by comparison of the nucleotide and/or amino acid sequence data to public or proprietary sequence databases. In some embodiments, computerized comparison methods are used to identify sequence motifs or predicted protein conformation domains that occur in other proteins of known structure and/or function. Methods to identify protein sequences that fold into a known three-dimensional structure are known. Bowie et al. Science 253:164 (1991). Thus, the foregoing examples demonstrate that those of skill in the art can recognize sequence motifs and structural conformations that can be used to define structural and functional domains in accordance with the disclosure.

Suitable amino acid substitutions are those that: (1) reduce susceptibility to proteolysis, (2) reduce susceptibility to oxidation, (3) alter binding affinity for forming protein complexes, (4) alter binding affinities, and (5) confer or modify other physicochemical or functional properties of such analogs. Analogs can include various muteins of a sequence other than the naturally-occurring peptide sequence. For example, single or multiple amino acid substitutions (for example, conservative amino acid substitutions) can be made in the naturally-occurring sequence (for example, in the portion of the polypeptide outside the domain(s) forming intermolecular contacts. A conservative amino acid substitution should not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et at. Nature 354:105 (1991).

The term "polypeptide fragment" as used herein refers to a polypeptide that has an amino terminal and/or carboxy-terminal deletion and/or one or more internal deletion(s), but where the remaining amino acid sequence is identical to the corresponding positions in the naturally-occurring sequence deduced, for example, from a full length cDNA sequence. Fragments typically are at least 5, 6, 8 or 10 amino acids long, in some embodiments, at least 14 amino acids long, in some embodiments, at least 20 amino acids long, usually at least 50 amino acids long, and in some embodiments, at least 70 amino acids long. The term "analog" as used herein refers to polypeptides that are comprised of a segment of at least 25 amino acids that has substantial identity to a portion of a deduced amino acid sequence and that has specific binding to the target, under suitable binding conditions. Typically, polypeptide analogs comprise a conservative amino acid substitution (or addition or deletion) with respect to the naturally-occurring sequence. Analogs typically are at least 20 amino acids long, in some embodiments, at least 50 amino acids long or longer, and can often be as long as a full-length naturally-occurring polypeptide.

The term "agent" is used herein to denote a chemical compound, a mixture of chemical compounds, a biological macromolecule, or an extract made from biological materials.

As used herein, the terms "label" or "labeled" refers to incorporation of a detectable marker, e.g., by incorporation of a radiolabeled amino acid or attachment to a polypeptide of biotinyl moieties that can be detected by marked avidin (e.g., streptavidin containing a fluorescent marker or enzymatic activity that can be detected by optical or calorimetric methods). In certain situations, the label or marker can also be therapeutic. Various methods of labeling polypeptides and glycoproteins are known in the art and can be used. Examples of labels for polypeptides include, but are not limited to, the following: radioisotopes or radionuclides (e.g., $^{3}H$, $^{14}C$, $^{15}N$, 35S, $^{90}Y$, $^{99}Tc$, $^{111}In$, $^{125}I$, $^{131}I$), fluorescent labels (e.g., FITC, rhodamine, lanthanide phosphors), enzymatic labels (e.g., horseradish peroxidase, p-galactosidase, luciferase, alkaline phosphatase), chemiluminescent, biotinyl groups, predetermined polypeptide epitopes recognized by a secondary reporter (e.g., leucine zipper pair sequences, binding sites for secondary antibodies, metal binding domains, epitope tags). In some embodiments, labels are attached by spacer arms of various lengths to reduce potential steric hindrance. The term "pharmaceutical agent or drug" as used herein refers to a chemical compound or composition capable of inducing a desired therapeutic effect when properly administered to a patient.

Other chemistry terms herein are used according to conventional usage in the art, as exemplified by The McGraw-Hill Dictionary of Chemical Terms (Parker, S., Ed., McGraw-Hill, San Francisco (1985)).

As used herein, "substantially pure" means an object species is the predominant species present (i.e., on a molar basis it is more abundant than any other individual species in the composition), and in some embodiments, a substantially purified fraction is a composition wherein the object species comprises at least about 50 percent (on a molar basis) of all macromolecular species present.

Generally, a substantially pure composition will comprise more than about 80 percent of all macromolecular species present in the composition, in some embodiments, more than about 85%, 90%, 95%, and 99%. In some embodiments, the object species is purified to essential homogeneity (contaminant species cannot be detected in the composition by conventional detection methods) wherein the composition consists essentially of a single macromolecular species.

The term patient includes human and veterinary subjects.

Antibodies and/or activatable antibodies of the disclosure specifically bind a given target, e.g., a human target protein such as human PD-1. Also included in the disclosure are antibodies and/or activatable antibodies that bind to the same epitope as the antibodies and/or activatable antibodies described herein. Also included in the disclosure are antibodies and/or antibodies activatable antibodies that compete with an anti-PD-1 antibody and/or an anti-PD-1 activatable antibody described herein for binding to PD-1, e.g., human PD-1. Also included in the disclosure are antibodies and/or antibodies activatable antibodies that cross-compete with an anti-PD-1 antibody and/or an anti-PD-1 activatable antibody described herein for binding to PD-1, e.g., human PD-1.

Those skilled in the art will recognize that it is possible to determine, without undue experimentation, if a monoclonal antibody (e.g., a murine monoclonal or humanized antibody) has the same specificity as a monoclonal antibody used in the methods described herein by ascertaining whether the former prevents the latter from binding to the target. If the monoclonal antibody being tested competes with the monoclonal antibody of the disclosure, as shown by a decrease in binding by the monoclonal antibody of the disclosure, then the two monoclonal antibodies bind to the same, or a closely related, epitope. An alternative method for determining whether a monoclonal antibody has the specificity of a monoclonal antibody of the disclosure is to pre-incubate the monoclonal antibody of the disclosure with the target and then add the monoclonal antibody being tested to determine if the monoclonal antibody being tested is inhibited in its ability to bind the target. If the monoclonal antibody being tested is inhibited then, in all likelihood, it has the same, or functionally equivalent, epitopic specificity as the monoclonal antibody of the disclosure.

Multispecific Activatable Antibodies

The disclosure also provides multispecific anti-PD-1 activatable antibodies. The multispecific activatable antibodies provided herein are multispecific antibodies that recognize PD-1 and at least one or more different antigens or epitopes and that include at least one masking moiety (MM) linked to at least one antigen- or epitope-binding domain of the multispecific antibody such that coupling of the MM reduces the ability of the antigen- or epitope-binding domain to bind its target. In some embodiments, the MM is coupled to the antigen- or epitope-binding domain of the multispecific antibody via a cleavable moiety (CM) that functions as a substrate for at least one protease. The activatable multispecific antibodies provided herein are stable in circulation, activated at intended sites of therapy and/or diagnosis but not in normal, i.e., healthy tissue, and, when activated, exhibit binding to a target that is at least comparable to the corresponding, unmodified multispecific antibody.

In some embodiments, the multispecific activatable antibodies are designed to engage immune effector cells, also referred to herein as immune-effector cell engaging multispecific activatable antibodies. In some embodiments, the multispecific activatable antibodies are designed to engage leukocytes, also referred to herein as leukocyte engaging multispecific activatable antibodies. In some embodiments, the multispecific activatable antibodies are designed to engage T cells, also referred to herein as T-cell engaging multispecific activatable antibodies. In some embodiments, the multispecific activatable antibodies engage a surface antigen on a leukocyte, such as on a T cell, on a natural killer (NK) cell, on a myeloid mononuclear cell, on a macrophage, and/or on another immune effector cell. In some embodiments, the immune effector cell is a leukocyte. In some embodiments, the immune effector cell is a T cell. In some embodiments, the immune effector cell is a NK cell. In some embodiments, the immune effector cell is a mononuclear cell, such as a myeloid mononuclear cell. In some embodiments, the multispecific activatable antibodies are designed to bind or otherwise interact with more than one target and/or more than one epitope, also referred to herein as multi-antigen targeting activatable antibodies. As used herein, the terms "target" and "antigen" are used interchangeably.

In some embodiments, immune effector cell engaging multispecific activatable antibodies of the disclosure include a targeting antibody or antigen-binding fragment thereof that binds PD-1 and an immune effector cell engaging antibody or antigen-binding portion thereof, where at least one of the targeting antibody or antigen-binding fragment thereof and/or the immune effector cell engaging antibody or antigen-binding portion thereof is masked. In some embodiments, the immune effector cell engaging antibody or antigen binding fragment thereof includes a first antibody or antigen-binding fragment thereof (AB1) that binds a first, immune effector cell engaging target, where the AB1 is attached to a masking moiety (MM1) such that coupling of the MM1 reduces the ability of the AB1 to bind the first target. In some embodiments, the targeting antibody or antigen-binding fragment thereof includes a second antibody or fragment thereof that includes a second antibody or antigen-binding fragment thereof (AB2) that binds PD-1, where the AB2 is attached to a masking moiety (MM2) such that coupling of the MM2 reduces the ability of the AB2 to bind PD-1. In some embodiments, the immune effector cell engaging antibody or antigen binding fragment thereof includes a first antibody or antigen-binding fragment thereof (AB1) that binds a first, immune effector cell engaging target, where the AB1 is attached to a masking moiety (MM1) such that coupling of the MM1 reduces the ability of the AB1 to bind the first target, and the targeting antibody or antigen-binding fragment thereof includes a second antibody or fragment thereof that includes a second antibody or antigen-binding fragment thereof (AB2) that binds PD-1, where the AB2 is attached to a masking moiety (MM2) such that coupling of the MM2 reduces the ability of the AB2 to bind PD-1. In some embodiments, the non-immune effector cell engaging antibody is a cancer targeting antibody. In some embodiments the non-immune cell effector antibody is an IgG. In some embodiments the immune effector cell engaging antibody is a scFv. In some embodiments the PD-1-targeting antibody (e.g., non-immune cell effector antibody) is an IgG and the immune effector cell engaging antibody is a scFv. In some embodiments, the immune effector cell is a leukocyte. In some embodiments, the immune effector cell is a T cell. In some embodiments, the immune effector cell is a NK cell. In some embodiments, the immune effector cell is a myeloid mononuclear cell.

In some embodiments, T-cell engaging multispecific activatable antibodies of the disclosure include a PD-1-targeting antibody or antigen-binding fragment thereof and a T-cell engaging antibody or antigen-binding portion thereof, where at least one of the PD-1-targeting antibody or antigen-binding fragment thereof and/or the T-cell engaging antibody or antigen-binding portion thereof is masked. In some embodiments, the T-cell engaging antibody or antigen binding fragment thereof includes a first antibody or antigen-binding fragment thereof (AB1) that binds a first, T-cell engaging target, where the AB1 is attached to a masking moiety (MM1) such that coupling of the MM1 reduces the ability of the AB1 to bind the first target. In some embodiments, the targeting antibody or antigen-binding fragment thereof includes a second antibody or fragment thereof that includes a second antibody or antigen-binding fragment thereof (AB2) that binds PD-1, where the AB2 is attached to a masking moiety (MM2) such that coupling of the MM2 reduces the ability of the AB2 to bind PD-1. In some embodiments, the T-cell engaging antibody or antigen binding fragment thereof includes a first antibody or antigen-binding fragment thereof (AB1) that binds a first, T-cell engaging target, where the AB1 is attached to a masking moiety (MM1) such that coupling of the MM1 reduces the ability of the AB1 to bind the first target, and the targeting antibody or antigen-binding fragment thereof includes a second antibody or fragment thereof that includes a second antibody or antigen-binding fragment thereof (AB2) that binds PD-1, where the AB2 is attached to a masking moiety (MM2) such that coupling of the MM2 reduces the ability of the AB2 to bind PD-1.

In some embodiments of an immune effector cell engaging multispecific activatable antibody, one antigen is PD-1, and another antigen is typically a stimulatory or inhibitory receptor present on the surface of a T-cell, natural killer (NK) cell, myeloid mononuclear cell, macrophage, and/or other immune effector cell, such as, but not limited to, B7-H4, BTLA, CD3, CD4, CD8, CD16a, CD25, CD27, CD28, CD32, CD56, CD137, CTLA-4, GITR, HVEM, ICOS, LAG3, NKG2D, OX40, TIGIT, TIM3, or VISTA. In some embodiments, the antigen is a stimulatory receptor present on the surface of a T cell or NK cell; examples of such stimulatory receptors include, but are not limited to, CD3, CD27, CD28, CD137 (also referred to as 4-1BB), GITR, HVEM, ICOS, NKG2D, and OX40. In some embodiments, the antigen is an inhibitory receptor present on the surface of a T-cell; examples of such inhibitory receptors include, but are not limited to, BTLA, CTLA-4, LAG3, TIGIT, TIM3, and NK-expressed KIRs. The antibody domain conferring specificity to the T-cell surface antigen can also be substituted by a ligand or ligand domain that binds to a T-cell receptor, a NK-cell receptor, a macrophage receptor, and/or other immune effector cell receptor, such as, but not limited to, B7-1, B7-2, B7H3, PDL1, PDL2, or TNFSF9.

In some embodiments, the T-cell engaging multispecific activatable antibody includes an anti-CD3 epsilon (CD3ε, also referred to herein as CD3e and CD3) scFv and a targeting antibody or antigen-binding fragment thereof, where at least one of the anti-CD3ε scFv and/or the targeting antibody or antigen-binding portion thereof is masked. In some embodiments, the CD3ε scFv includes a first antibody or antigen-binding fragment thereof (AB1) that binds CD3ε, where the AB1 is attached to a masking moiety (MM1) such that coupling of the MM1 reduces the ability of the AB1 to bind CD3ε. In some embodiments, the targeting antibody or antigen-binding fragment thereof includes a second antibody or fragment thereof that includes a second antibody or antigen-binding fragment thereof (AB2) that binds PD-1, where the AB2 is attached to a masking moiety (MM2) such that coupling of the MM2 reduces the ability of the AB2 to bind PD-1. In some embodiments, the CD3ε scFv includes a first antibody or antigen-binding fragment thereof (AB1) that binds CD3ε, where the AB1 is attached to a masking moiety (MM1) such that coupling of the MM1 reduces the ability of the AB1 to bind CD3ε, and the targeting antibody or antigen-binding fragment thereof includes a second antibody or fragment thereof that includes a second antibody or antigen-binding fragment thereof (AB2) that binds PD-1, where the AB2 is attached to a masking moiety (MM2) such that coupling of the MM2 reduces the ability of the AB2 to bind PD-1.

In some embodiments, the multi-antigen targeting antibodies and/or multi-antigen targeting activatable antibodies include at least a first antibody or antigen-binding fragment thereof that binds a first target and/or first epitope and a second antibody or antigen-binding fragment thereof that binds a second target and/or a second epitope. In some embodiments, the multi-antigen targeting antibodies and/or multi-antigen targeting activatable antibodies bind two or more different targets. In some embodiments, the multi-antigen targeting antibodies and/or multi-antigen targeting activatable antibodies bind two or more different epitopes on the same target. In some embodiments, the multi-antigen targeting antibodies and/or multi-antigen targeting activatable antibodies bind a combination of two or more different targets and two or more different epitopes on the same target.

In some embodiments, a multispecific activatable antibody comprising an IgG has the IgG variable domains masked. In some embodiments, a multispecific activatable antibody comprising a scFv has the scFv domains masked. In some embodiments, a multispecific activatable antibody has both IgG variable domains and scFv domains, where at least one of the IgG variable domains is coupled to a masking moiety. In some embodiments, a multispecific activatable antibody has both IgG variable domains and scFv domains, where at least one of the scFv domains is coupled to a masking moiety. In some embodiments, a multispecific activatable antibody has both IgG variable domains and scFv domains, where at least one of the IgG variable domains is coupled to a masking moiety and at least one of the scFv domains is coupled to a masking moiety. In some embodiments, a multispecific activatable antibody has both IgG variable domains and scFv domains, where each of the IgG variable domains and the scFv domains is coupled to its own masking moiety. In some embodiments, one antibody domain of a multispecific activatable antibody has specificity for a target antigen and another antibody domain has specificity for a T-cell surface antigen. In some embodiments, one antibody domain of a multispecific activatable antibody has specificity for a target antigen and another antibody domain has specificity for another target antigen. In some embodiments, one antibody domain of a multispecific activatable antibody has specificity for an epitope of a target antigen and another antibody domain has specificity for another epitope of the target antigen.

In a multispecific activatable antibody, a scFv can be fused to the carboxyl terminus of the heavy chain of an IgG activatable antibody, to the carboxyl terminus of the light chain of an IgG activatable antibody, or to the carboxyl termini of both the heavy and light chains of an IgG activatable antibody. In a multispecific activatable antibody, a scFv can be fused to the amino terminus of the heavy chain of an IgG activatable antibody, to the amino terminus of the light chain of an IgG activatable antibody, or to the amino termini of both the heavy and light chains of an IgG activatable antibody. In a multispecific activatable antibody, a scFv can be fused to any combination of one or more carboxyl termini and one or more amino termini of an IgG activatable antibody. In some embodiments, a masking moiety (MM) linked to a cleavable moiety (CM) is attached to and masks an antigen binding domain of the IgG. In some embodiments, a masking moiety (MM) linked to a cleavable moiety (CM) is attached to and masks an antigen binding domain of at least one scFv. In some embodiments, a masking moiety (MM) linked to a cleavable moiety (CM) is attached to and masks an antigen binding domain of an IgG and a masking moiety (MM) linked to a cleavable moiety (CM) is attached to and masks an antigen binding domain of at least one scFv.

The disclosure provides examples of multispecific activatable antibody structures which include, but are not limited to, the following: (VL-CL)$_2$:(VH-CH1-CH2-CH3-L4-VH*-L3-VL*-L2-CM-L1-MM)$_2$; (VL-CL)$_2$:(VH-CH1-CH2-CH3-L4-VL*-L3-VH*-L2-CM-L1-MM)$_2$; (MM-L1-CM-L2-VL-CL)$_2$:(VH-CH1-CH2-CH3-L4-VH*-L3-V-L*)$_2$; (MM-L1-CM-L2-VL-CL)$_2$:(VH-CH1-CH2-CH3-L4-VL*-L3-VH*)$_2$; (VL-CL)$_2$:(MM-L1-CM-L2-VL*-L3-VH*-L4-VH-CH1-CH2-CH3)$_2$; (VL-CL)$_2$:(MM-L1-CM-L2-VH*-L3-VL*-L4-VH-CH1-CH2-CH3)$_2$; (MM-L1-CM-L2-VL-CL)$_2$: (VL*-L3-VH*-L4-VH-CH1-CH2-CH3)$_2$; (MM-L1-CM-L2-VL-CL)$_2$:(VH*-L3-VL*-L4-VH-CH1-CH2-CH3)$_2$; (VL-CL-L4-VH*-L3-VL*-L2-CM-L1-MM)$_2$:(VH-CH1-CH2-CH3)$_2$; (VL-CL-L4-VL*-L3-VH*-L2-CM-L1-MM)$_2$:(VH-CH1-CH2-CH3)$_2$; (MM-L1-CM-L2-VL*-L3-VH*-L4-VL-CL)$_2$:(VH-CH1-CH2-CH3)$_2$; (MM-L1-CM-L2-VH*-L3-VL*-L4-VL-CL)$_2$: (VH-CH1-CH2-CH3)$_2$; (VL-CL-L4-VH*-L3-VL*-L2-CM-L1-MM)$_2$: (MM-L1-CM-L2-VL*-L3-VH*-L4-VH-CH1-CH2-CH3)$_2$; (VL-CL-L4-VH*-L3-VL*-L2-CM-L1-MM)$_2$: (MM-L1-CM-L2-VH*-L3-VL*-L4-VH-CH1-CH2-CH3)$_2$; (VL-CL-L4-VL*-L3-VH*-L2-CM-L1-MM)$_2$: (MM-L1-CM-L2-VL*-L3-VH*-L4-VH-CH1-CH2-CH3)$_2$; (VL-CL-L4-VL*-L3-VH*-L2-CM-L1-MM)$_2$: (MM-L1-CM-L2-VH*-L3-VL*-L4-VH-CH1-CH2-CH3)$_2$; (VL-CL-L4-VH*-L3-VL*)$_2$: (MM-L1-CM-L2-VL*-L3-VH*-L4-VH-CH1-CH2-CH3)$_2$; (VL-CL-L4-VH*-L3-VL*)$_2$: (MM-L1-CM-L2-VH*-L3-VL*-L4-VH-CH1-CH2-CH3)$_2$; (VL-CL-L4-VL*-L3-VH*)$_2$: (MM-L1-CM-L2-VL*-L3-VH*-L4-VH-CH1-CH2-CH3)$_2$; (VL-CL-L4-VL*-L3-VH*)$_2$: (MM-L1-CM-L2-VH*-L3-VL*-L4-VH-CH1-CH2-CH3)$_2$; (VL-CL-L4-VH*-L3-VL*-L2-CM-L1-MM)$_2$: (VL*-L3-VH*-L4-VH-CH1-CH2-CH3)$_2$; (VL-CL-L4-VH*-L3-VL*-L2-CM-L1-MM)$_2$: (VH*-L3-VL*-L4-VH-CH1-CH2-CH3)$_2$; (VL-CL-L4-VL*-L3-VH*-L2-CM-L1-MM)$_2$: (VL*-L3-VH*-L4-VH-CH1-CH2-CH3)$_2$; or (VL-CL-L4-VL*-L3-VH*-L2-CM-L1-MM)$_2$: (VH*-L3-VL*-L4-VH-CH1-CH2-CH3)$_2$, wherein: VL and VH represent the light and heavy variable domains of the first specificity, contained in the IgG; VL* and VH* represent the variable domains of the second specificity, contained in the scFv; L1 is a linker peptide connecting the masking moiety (MM) and the cleavable moiety (CM); L2 is a linker peptide connecting the cleavable moiety (CM), and the antibody; L3 is a linker peptide connecting the variable domains of the scFv; L4 is a linker peptide connecting the antibody of the first specificity to the antibody of the second specificity; CL is the light-chain constant domain; and CH1, CH2, CH3 are the heavy chain constant domains. The first and second specificities can be toward any antigen or epitope.

In some embodiments of a T-cell engaging multispecific activatable antibody, one antigen is PD-1, and another antigen is typically a stimulatory (also referred to herein as activating) or inhibitory receptor present on the surface of a T-cell, natural killer (NK) cell, myeloid mononuclear cell, macrophage, and/or other immune effector cell, such as, but not limited to, B7-H4, BTLA, CD3, CD4, CD8, CD16a, CD25, CD27, CD28, CD32, CD56, CD137 (also referred to as TNFRSF9), CTLA-4, GITR, HVEM, ICOS, LAG3, NKG2D, OX40, PD-1, TIGIT, TIM3, or VISTA. The antibody domain conferring specificity to the T-cell surface antigen can also be substituted by a ligand or ligand domain that binds to a T-cell receptor, a NK-cell receptor, a macrophage receptor, and/or other immune effector cell receptor.

In some embodiments, the targeting antibody is an anti-PD-1 antibody disclosed herein. In some embodiments, the targeting antibody can be in the form an activatable antibody. In some embodiments, the scFv(s) can be in the form of a Pro-scFv (see, e.g., WO 2009/025846, WO 2010/081173).

In some embodiments, the scFv is specific for binding CD38, and comprises or is derived from an antibody or fragment thereof that binds CD38, e.g., CH2527, FN18, H2C, OKT3, 2C11, UCHT1, or V9. In some embodiments, the scFv is specific for binding CTLA-4 (also referred to herein as CTLA and CTLA4).

In some embodiments, the anti-CTLA-4 scFv includes the amino acid sequence:

(SEQ ID NO: 585)
GGGSGGGGSGSGGGSGGGGSGGGEIVLTQSPGTLSLSPGERATLSCRASQ

SVSSSYLAWYQQKPGQAPRLLIYGASSRATGIPDRFSGSGSGTDFTLTIS

RLEPEDFAVYYCQQYGSSPLTFGGGTKVEIKRSGGSTITSYNVYYTKLSS

SGTQVQLVQTGGGVVQPGRSLRLSCAASGSTFSSYAMSWVRQAPGKGLEW

VSAISGSGGSTYYADSVKGRFTISRDNSKNTLYLQMNSLRAEDTAVYYCA

TNSLYWYFDLWGRGTLVTVSSAS

In some embodiments, the anti-CTLA-4 scFv includes the amino acid sequence that is at least 90%, 91%, 92%, 93%, 94%, 95%, 96%, 97%, 98%, 99% or more identical to the amino acid sequence of SEQ ID NO: 585.

In some embodiments, the anti-CD3ε scFv includes the amino acid sequence:

(SEQ ID NO: 586)
GGGSGGGGSGSGGGSGGGGSGGGQVQLQQSGAELARPGASVKMSCKASGY

TFTRYTMHWVKQRPGQGLEWIGYINPSRGYTNYNQKFKDKATLTTDKSSS

TAYMQLSSLTSEDSAVYYCARYYDDHYCLDYWGQGTTLTVSSGGGGSG

GGGSGGGGSQIVLTQSPAIMSASPGEKVTMTCSASSSVSYMNWYQQKS

GTSPKRWIYDTSKLASGVPAHFRGSGSGTSYSLTISGMEAEDAATYYCQ

QWSSNPFTFGSGTKLEINR

In some embodiments, the anti-CD3ε scFv includes the amino acid sequence that is at least 90%, 91%, 92%, 93%, 94%, 95%, 96%, 97%, 98%, 99% or more identical to the amino acid sequence of SEQ ID NO: 586.

In some embodiments, the scFv is specific for binding one or more T-cells, one or more NK-cells and/or one or more macrophages. In some embodiments, the scFv is specific for binding a target selected from the group consisting of B7-H4, BTLA, CD3, CD4, CD8, CD16a, CD25, CD27, CD28, CD32, CD56, CD137, CTLA-4, GITR, HVEM, ICOS, LAG3, NKG2D, OX40, TIGIT, TIM3, or VISTA.

In some embodiments, the multispecific activatable antibody also includes an agent conjugated to the AB. In some embodiments, the agent is a therapeutic agent. In some embodiments, the agent is conjugated to the multispecific activatable antibody via a linker. In some embodiments, the agent is conjugated to the AB via a cleavable linker. In some embodiments, the linker is a non-cleavable linker.

In some embodiments, the multispecific activatable antibody also includes a detectable moiety. In some embodiments, the detectable moiety is a diagnostic agent.

In some embodiments, the multispecific activatable antibody naturally contains one or more disulfide bonds. In some embodiments, the multispecific activatable antibody can be engineered to include one or more disulfide bonds.

The disclosure also provides an isolated nucleic acid molecule encoding a multispecific activatable antibody described herein, as well as vectors that include these isolated nucleic acid sequences. The disclosure provides methods of producing a multispecific activatable antibody by culturing a cell under conditions that lead to expression of the activatable antibody, wherein the cell comprises such a nucleic acid molecule. In some embodiments, the cell comprises such a vector.

The disclosure also provides a method of manufacturing multispecific activatable antibodies of the disclosure by (a) culturing a cell comprising a nucleic acid construct that encodes the multispecific activatable antibody under conditions that lead to expression of the multispecific activatable, and (b) recovering the multispecific activatable antibody. Suitable AB, MM, and/or CM include any of the AB, MM, and/or CM disclosed herein.

The disclosure also provides multispecific activatable antibodies and/or multispecific activatable antibody compositions that include at least a first antibody or antigen-binding fragment thereof (AB1) that specifically binds a first target or first epitope and a second antibody or antigen-biding fragment thereof (AB2) that binds a second target or a second epitope, where at least AB1 is coupled or otherwise attached to a masking moiety (MM1), such that coupling of the MM1 reduces the ability of AB1 to bind its target. In some embodiments, the MM1 is coupled to AB1 via a first cleavable moiety (CM1) sequence that includes a substrate for a protease, for example, a protease that is co-localized with the target of AB1 at a treatment site or a diagnostic site in a subject. The multispecific activatable antibodies provided herein are stable in circulation, activated at intended sites of therapy and/or diagnosis but not in normal, i.e., healthy tissue, and, when activated, exhibit binding to the target of AB1 that is at least comparable to the corresponding, unmodified multispecific antibody. Suitable AB, MM, and/or CM include any of the AB, MM, and/or CM disclosed herein.

The disclosure also provides compositions and methods that include a multispecific activatable antibody that includes at least a first antibody or antibody fragment (AB1) that specifically binds a target and a second antibody or antibody fragment (AB2), where at least the first AB in the multispecific activatable antibody is coupled to a masking moiety (MM1) that decreases the ability of AB1 to bind its target. In some embodiments, each AB is coupled to a MM that decreases the ability of its corresponding AB to each target. For example, in bispecific activatable antibody embodiments, AB1 is coupled to a first masking moiety (MM1) that decreases the ability of AB1 to bind its target, and AB2 is coupled to a second masking moiety (MM2) that decreases the ability of AB2 to bind its target. In some embodiments, the multispecific activatable antibody comprises more than two AB regions; in such embodiments, AB1 is coupled to a first masking moiety (MM1) that decreases the ability of AB1 to bind its target, AB2 is coupled to a second masking moiety (MM2) that decreases the ability of AB2 to bind its target, AB3 is coupled to a third masking moiety (MM3) that decreases the ability of AB3 to bind its target, and so on for each AB in the multispecific activatable antibody. Suitable AB, MM, and/or CM include any of the AB, MM, and/or CM disclosed herein.

In some embodiments, the multispecific activatable antibody further includes at least one cleavable moiety (CM) that is a substrate for a protease, where the CM links a MM to an AB. For example, in some embodiments, the multispecific activatable antibody includes at least a first antibody or antibody fragment (AB1) that specifically binds a target and a second antibody or antibody fragment (AB2), where at least the first AB in the multispecific activatable antibody is coupled via a first cleavable moiety (CM1) to a masking moiety (MM1) that decreases the ability of AB1 to bind its target. In some bispecific activatable antibody embodiments, AB1 is coupled via CM1 to MM1, and AB2 is coupled via a second cleavable moiety (CM2) to a second masking moiety (MM2) that decreases the ability of AB2 to bind its target. In some embodiments, the multispecific activatable antibody comprises more than two AB regions; in some of these embodiments, AB1 is coupled via CM1 to MM1, AB2 is coupled via CM2 to MM2, and AB3 is coupled via a third cleavable moiety (CM3) to a third masking moiety (MM3) that decreases the ability of AB3 to bind its target, and so on for each AB in the multispecific activatable antibody. Suitable AB, MM, and/or CM include any of the AB, MM, and/or CM disclosed herein.

Activatable antibodies Having Non-Binding Steric Moieties or Binding Partners for Non-Binding Steric Moieties The disclosure also provides activatable antibodies that include non-binding steric moieties (NB) or binding partners (BP) for non-binding steric moieties, where the BP recruits or otherwise attracts the NB to the activatable antibody. The activatable antibodies provided herein include, for example, an activatable antibody that includes a non-binding steric moiety (NB), a cleavable linker (CL) and antibody or antibody fragment (AB) that binds a target; an activatable antibody that includes a binding partner for a non-binding steric moiety (BP), a CL and an AB; and an activatable antibody that includes a BP to which an NB has been recruited, a CL and an AB that binds the target. Activatable antibodies in which the NB is covalently linked to the CL and AB of the activatable antibody or is associated by interaction with a BP that is covalently linked to the CL and AB of the activatable antibody are referred to herein as "NB-containing activatable antibodies." By activatable or switchable is meant that the activatable antibody exhibits a first level of binding to a target when the activatable antibody is in an inhibited, masked or uncleaved state (i.e., a first conformation), and a second level of binding to the target when the activatable antibody is in an uninhibited, unmasked and/or cleaved state (i.e., a second conformation, i.e., activated antibody), where the second level of target binding is greater than the first level of target binding. The activatable antibody compositions can exhibit increased bioavailability and more favorable biodistribution compared to conventional antibody therapeutics.

In some embodiments, activatable antibodies provide for reduced toxicity and/or adverse side effects that could otherwise result from binding of the at non-treatment sites and/or non-diagnostic sites if the AB were not masked or otherwise inhibited from binding to such a site.

Anti-PD-1 activatable antibodies that include a non-binding steric moiety (NB) can be made using the methods set forth in PCT Publication No. WO 2013/192546, the contents of which are hereby incorporated by reference in their entirety.

Use of Antibodies and Activatable Antibodies

It will be appreciated that administration of therapeutic entities in accordance with the disclosure will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences (15th ed, Mack Publishing Company, Easton, Pa. (1975)), particularly Chapter 87 by Blaug, Seymour, therein. These formulations include, for example, powders, pastes, ointments, jellies, waxes, oils, lipids, lipid (cationic or anionic) containing vesicles (such as Lipofectin™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. Any of the foregoing mixtures can be appropriate in treatments and therapies in accordance with the present disclosure, provided that the active ingredient in the formulation is not inactivated by the formulation and the formulation is physiologically compatible and tolerable with the route of administration. See also Baldrick P. "Pharmaceutical excipient development: the need for preclinical guidance." Regul. Toxicol Pharmacol. 32(2):210-8 (2000), Wang W. "Lyophilization and development of solid protein pharmaceuticals." Int. J. Pharm. 203(1-2):1-60 (2000), Charman W N "Lipids, lipophilic drugs, and oral drug delivery-some emerging concepts." J Pharm Sci.89(8):967-78 (2000), Powell et al. "Compendium of excipients for parenteral formulations" PDA J Pharm Sci Technol. 52:238-311 (1998) and the citations therein for additional information related to formulations, excipients and carriers well known to pharmaceutical chemists.

Therapeutic formulations of the disclosure, which include an anti-PD-1 antibody and/or activatable anti-PD-1 antibody, such as by way of non-limiting example, an antibody and/or an activatable antibody, are used to prevent, treat or otherwise ameliorate a disease or disorder associated with aberrant target expression and/or activity. For example, therapeutic formulations of the disclosure, which include an antibody and/or an activatable antibody, are used to treat or otherwise ameliorate a cancer or other neoplastic condition, inflammation, an inflammatory disorder, and/or an autoimmune disease. In some embodiments, the cancer is a solid tumor or a hematologic malignancy where the target is expressed. In some embodiments, the cancer is a solid tumor where the target is expressed. In some embodiments, the cancer is a hematologic malignancy where the target is expressed. In some embodiments, the target is expressed on parenchyma (e.g., in cancer, the portion of an organ or tissue that often carries out function(s) of the organ or tissue). In some embodiments, the target is expressed on a cell, tissue, or organ. In some embodiments, the target is expressed on stroma (i.e., the connective supportive framework of a cell, tissue, or organ). In some embodiments, the target is expressed on an osteoblast. In some embodiments, the target is expressed on the endothelium (vasculature). In some embodiments, the target is expressed on a cancer stem cell.

Efficaciousness of prevention, amelioration or treatment is determined in association with any known method for diagnosing or treating the disease or disorder associated with target expression and/or activity, such as, for example, aberrant target expression and/or activity. Prolonging the survival of a subject or otherwise delaying the progression of the disease or disorder associated with target expression and/or activity, e.g., aberrant target expression and/or activity, in a subject indicates that the antibody and/or activatable antibody confers a clinical benefit.

An antibody and/or an activatable antibody can be administered in the form of pharmaceutical compositions. Principles and considerations involved in preparing such compositions, as well as guidance in the choice of components are provided, for example, in Remington: The Science And Practice Of Pharmacy 19th ed. (Alfonso R. Gennaro, et al., editors) Mack Pub. Co., Easton, Pa.: 1995; Drug Absorption Enhancement: Concepts, Possibilities, Limitations, And Trends, Harwood Academic Publishers, Langhorne, Pa., 1994; and Peptide And Protein Drug Delivery (Advances In Parenteral Sciences, Vol. 4), 1991, M. Dekker, New York.

In some embodiments where antibody fragments are used, the smallest fragment that specifically binds to the binding domain of the target protein is selected. For example, based upon the variable-region sequences of an antibody, peptide molecules can be designed that retain the ability to bind the target protein sequence. Such peptides can be synthesized chemically and/or produced by recombinant DNA technology. (See, e.g., Marasco et al., Proc. Natl. Acad. Sci. USA, 90: 7889-7893 (1993)). The formulation can also contain more than one active compounds as necessary for the particular indication being treated, for example, in some embodiments, those with complementary activities that do not adversely affect each other. In some embodiments, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

The active ingredients can also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles, and nanocapsules) or in macroemulsions.

The formulations to be used for in vivo administration must be sterile. This is readily accomplished by filtration through sterile filtration membranes.

Sustained-release preparations can be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(–)-3-hydroxybutyric acid. While polymers such as ethylene-vinyl acetate and lactic acid-glycolic acid enable release of molecules for over 100 days, certain hydrogels release proteins for shorter time periods.

In some embodiments, the antibody and/or activatable antibody contains a detectable label. An intact antibody, or a fragment thereof (e.g., Fab, scFv, or F(ab)$_2$) is used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. Included within the usage of the term "biological sample", therefore, is blood and a fraction or component of blood including blood serum, blood plasma, or lymph. That is, the detection method of the disclosure can be used to detect an analyte mRNA, protein, or genomic DNA in a biological sample in vitro as well as in vivo. For example, in vitro techniques for detection of an analyte mRNA include Northern hybridizations and in situ hybridizations. In vitro techniques for detection of an analyte protein include enzyme linked immunosorbent assays (ELISAs), Western blots, immunoprecipitations, immunochemical staining, and immunofluorescence. In vitro techniques for detection of an analyte genomic DNA include Southern hybridizations. Procedures for conducting immunoassays are described, for example in "ELISA: Theory and Practice: Methods in Molecular Biology", Vol. 42, J. R. Crowther (Ed.) Human Press, Totowa, N.J., 1995; "Immunoassay", E. Diamandis and T. Christopoulus, Academic Press, Inc., San Diego, Calif., 1996; and "Practice and Theory of Enzyme Immunoassays", P. Tijssen, Elsevier Science Publishers, Amsterdam, 1985. Furthermore, in vivo techniques for detection of an analyte protein include introducing into a subject a labeled anti-analyte protein antibody. For example, the antibody can be labeled with a radioactive marker whose presence and location in a subject can be detected by standard imaging techniques.

The antibodies and/or activatable antibodies of the disclosure are also useful in a variety of diagnostic and prophylactic formulations. In one embodiment, an antibody and/or an activatable antibody is administered to patients that are at risk of developing one or more of the aforementioned disorders. A patient's or organ's predisposition to one or more of the aforementioned disorders can be determined using genotypic, serological or biochemical markers.

In some embodiments of the disclosure, an antibody and/or an activatable antibody is administered to human individuals diagnosed with a clinical indication associated with one or more of the aforementioned disorders. Upon diagnosis, an antibody and/or an activatable antibody is administered to mitigate or reverse the effects of the clinical indication.

An antibody and/or an activatable antibody of the disclosure is also useful in the detection of a target in patient samples and accordingly are useful as diagnostics. For example, the antibodies and/or activatable antibodies, and conjugated versions thereof, of the disclosure are used in in vitro assays, e.g., ELISA, to detect target levels in a patient sample.

In some embodiments, anti-PDL1 antibodies are used as a diagnostic for patients who are more likely to respond favorably to treatment with an anti-PD-1 antibody and/or activatable antibody of the disclosure. In these embodiments, PD-L1 expression in tumor biopsies on both tumor cells and infiltrating immune cells and PD-L1 expression on immune cells in blood are used to indicate the presence of active immunity and, thus, potential for suppression of T cell activity through the engagement of PD-1 by PD-L1.

In one embodiment, an antibody, a conjugated antibody, an activatable antibody and/or a conjugated activatable antibody of the disclosure is immobilized on a solid support (e.g., the well(s) of a microtiter plate). The immobilized antibody, conjugated antibody, activatable antibody and/or conjugated activatable antibody serves as a capture antibody for any target that can be present in a test sample. Prior to contacting the immobilized antibody and/or activatable antibody, and/or conjugated versions thereof, with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen in the test sample is determined by comparison with a standard curve developed from the standard samples.

It will be appreciated that based on the results obtained using the antibodies and activatable antibodies of the disclosure, and conjugated versions thereof, in an in vitro diagnostic assay, it is possible to stage a disease in a subject based on expression levels of the target antigen. For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that can be considered characteristic of each stage is designated.

An antibody, a conjugated antibody, an activatable antibody and/or a conjugated activatable antibody can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies having an enzymatically cleavable CM can be used to detect the presence or absence of an enzyme that is capable of cleaving the CM. Such activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of activated antibodies (i.e., antibodies resulting from cleavage of an activatable antibody) in a given cell or tissue of a given host organism. Such accumulation of activated antibodies indicates not only that the tissue expresses enzymatic activity (or an increased reduction potential depending on the nature of the CM) but also that the tissue expresses target to which the activated antibody binds.

For example, the CM can be selected to be substrate for at least one protease found at the site of a tumor, at the site of a viral or bacterial infection at a biologically confined site (e.g., such as in an abscess, in an organ, and the like), and the like. The AB can be one that binds a target antigen. Using methods as disclosed herein, or when appropriate, methods familiar to one skilled in the art, a detectable label (e.g., a fluorescent label or radioactive label or radiotracer) can be conjugated to an AB or other region of an antibody and/or activatable antibody. Suitable detectable labels are discussed in the context of the above screening methods and additional specific examples are provided below. Using an AB specific to a protein or peptide of the disease state, along with at least one protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated antibodies in the disease tissue is enhanced relative to non-disease tissues.

In another example, activatable antibodies can be used to detect the presence or absence of a cleaving agent in a sample. For example, where the activatable antibodies contain a CM susceptible to cleavage by an enzyme, the activatable antibodies can be used to detect (either qualitatively or quantitatively) the presence of an enzyme in the sample. In another example, where the activatable antibodies contain a CM susceptible to cleavage by reducing agent, the activatable antibodies can be used to detect (either qualitatively or quantitatively) the presence of reducing conditions in a sample. To facilitate analysis in these methods, the activatable antibodies can be detectably labeled, and can be bound to a support (e.g., a solid support, such as a slide or bead). The detectable label can be positioned on a portion of the activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies prior to contacting with the sample e.g., the presence of and/or an increase in detectable signal due to cleavage of the activatable antibody by the cleaving agent in the sample.

Such detection methods can be adapted to also provide for detection of the presence or absence of a target that is capable of binding the AB of the activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the activatable antibodies as described above, and the presence or absence of the target can be detected by detection of a target-AB complex e.g., by use of a detectably labeled anti-target antibody.

Activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody is labeled with a detectable label. The detectable label can be a fluorescent dye, (e.g. a fluorophore, Fluorescein Isothiocyanate (FITC), Rhodamine Isothiocyanate (TRITC), an Alexa Fluor® label), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, activatable antibody indicates that the sample contains the target and contains a protease that is specific for the CM of the activatable antibody. In some embodiments, the presence of the protease can be confirmed using broad spectrum protease inhibitors such as those described herein, and/or by using an agent that is specific for the protease, for example, an antibody such as A11, which is specific for the protease matriptase and inhibits the proteolytic activity of matriptase; see e.g., International Publication Number WO 2010/129609, published 11 Nov.

2010. The same approach of using broad spectrum protease inhibitors such as those described herein, and/or by using a more selective inhibitory agent can be used to identify a protease that is specific for the CM of the activatable antibody. In some embodiments, the presence of the target can be confirmed using an agent that is specific for the target, e.g., another antibody, or the detectable label can be competed with unlabeled target. In some embodiments, unlabeled activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody.

These techniques are also useful in kits and/or as reagents for the detection, identification or characterization of protease activity in a variety of cells, tissues, and organisms based on the protease-specific CM in the activatable antibody.

The disclosure provides methods of using the antibodies and/or activatable antibodies in a variety of diagnostic and/or prophylactic indications. For example, the disclosure provides methods of detecting presence or absence of a cleaving agent and a target of interest in a subject or a sample by (i) contacting a subject or sample with an activatable antibody, wherein the activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent and the target are present in the subject or sample and wherein no detectable level of activated activatable antibody in the subject or sample indicates that the cleaving agent, the target or both the cleaving agent and the target are absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides methods of detecting presence or absence of a cleaving agent in a subject or a sample by (i) contacting a subject or sample with an activatable antibody in the presence of a target of interest, e.g., the target, wherein the activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent is present in the subject or sample and wherein no detectable level of activated activatable antibody in the subject or sample indicates that the cleaving agent is absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody comprises a masking moiety (MM), a cleavable moiety (CM) that is cleaved by the cleaving agent, e.g., a protease, and an antigen binding domain or fragment thereof (AB) that specifically binds the target of interest, wherein the activatable antibody in an uncleaved, non-activated state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB and is not a modified form of a natural binding partner of the AB; and (b) wherein, in an uncleaved, non-activated state, the MM interferes with specific binding of the AB to the target, and in a cleaved, activated state the MM does not interfere or compete with specific binding of the AB to the target; and (ii) measuring a level of activated activatable antibody in the subject or sample, wherein a detectable level of activated activatable antibody in the subject or sample indicates that the cleaving agent is present in the subject or sample and wherein no detectable level of activated activatable antibody in the subject or sample indicates that the cleaving agent is absent and/or not sufficiently present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides methods of detecting presence or absence of a cleaving agent in a subject or a sample by (i) contacting a subject or sample with an activatable antibody, wherein the activatable antibody comprises a masking moiety (MM), a cleavable moiety (CM) that is cleaved by the cleaving agent, e.g., a protease, an antigen binding domain (AB) that specifically binds the target, and a detectable label, wherein the activatable antibody in an uncleaved, non-activated state comprises a structural arrangement from N-terminus to C-terminus as follows: MM-CM-AB or AB-CM-MM; wherein the MM is a peptide that inhibits binding of the AB to the target, and wherein the MM does not have an amino acid sequence of a naturally occurring binding partner of the AB and is not a modified form of a natural binding partner of the AB; wherein, in an uncleaved, non-activated state, the MM interferes with specific binding of the AB to the target, and in a cleaved, activated state the MM does not interfere or compete with specific binding of the AB to the target; and wherein the detectable label is positioned on a portion of the activatable antibody that is released following cleavage of the CM; and (ii) measuring a level of detectable label in the subject or sample, wherein a detectable level of the detectable label in the subject or sample indicates that the cleaving agent is absent and/or not sufficiently present in the subject or sample and wherein no detectable level of the detectable label in the subject or sample indicates that the cleaving agent is present in the subject or sample. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody and/or conjugated activatable antibody (e.g., an activatable antibody to which a therapeutic agent is conjugated) described herein for use in contacting a subject or biological sample and means for detecting the level of activated activatable antibody and/or conjugated activatable antibody in the subject or biological sample, wherein a detectable level of activated activatable antibody in the subject or biological sample indicates that the cleaving agent and the target are present in the subject or biological sample and wherein no detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample.

The disclosure also provides methods of detecting presence or absence of a cleaving agent in a subject or a sample by (i) contacting a subject or biological sample with an activatable antibody in the presence of the target, and (ii) measuring a level of activated activatable antibody in the subject or biological sample, wherein a detectable level of activated activatable antibody in the subject or biological sample indicates that the cleaving agent is present in the subject or biological sample and wherein no detectable level of activated activatable antibody in the subject or biological sample indicates that the cleaving agent is absent and/or not sufficiently present in the subject or biological sample at a detectable level, such that protease cleavage of the activatable antibody cannot be detected in the subject or biological sample. Such an activatable antibody includes a masking moiety (MM), a cleavable moiety (CM) that is cleaved by the cleaving agent, e.g., a protease, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the detectable label is attached to the masking moiety. In some embodiments, the detectable label is attached to the cleavable moiety N-terminal to the protease cleavage site. In some embodiments, a single antigen binding site of the AB is masked. In some embodiments wherein an antibody of the disclosure has at least two antigen binding sites, at least one antigen binding site is masked and at least one antigen binding site is not masked. In some embodiments all antigen binding sites are masked. In some embodiments, the measuring step includes use of a secondary reagent comprising a detectable label.

The disclosure also provides kits for use in methods of detecting presence or absence of a cleaving agent and the target in a subject or a sample, where the kits include at least an activatable antibody and/or conjugated activatable antibody described herein for use in contacting a subject or biological sample with an activatable antibody in the presence of the target, and measuring a level of activated activatable antibody in the subject or biological sample, wherein a detectable level of activated activatable antibody in the subject or biological sample indicates that the cleaving agent is present in the subject or biological sample and wherein no detectable level of activated activatable antibody in the subject or biological sample indicates that the cleaving agent is absent and/or not sufficiently present in the subject or biological sample at a detectable level, such that protease cleavage of the activatable antibody cannot be detected in the subject or biological sample. Such an activatable antibody includes a masking moiety (MM), a cleavable moiety (CM) that is cleaved by the cleaving agent, e.g., a protease, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the detectable label is attached to the masking moiety. In some embodiments, the detectable label is attached to the cleavable moiety N-terminal to the protease cleavage site. In some embodiments, a single antigen binding site of the AB is masked. In some embodiments wherein an antibody of the disclosure has at least two antigen binding sites, at least one antigen binding site is masked and at least one antigen binding site is not masked. In some embodiments all antigen binding sites are masked. In some embodiments, the measuring step includes use of a secondary reagent comprising a detectable label.

The disclosure also provides kits for use in methods of detecting presence or absence of a cleaving agent in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein the activatable antibody includes a detectable label that is positioned on a portion of the activatable antibody that is released following cleavage of the CM, wherein a detectable level of activated activatable antibody in the subject or biological sample indicates that the cleaving agent is absent and/or not sufficiently present in the subject or biological sample such that the target binding and/or protease cleavage of the activatable antibody cannot be detected in the subject or biological sample, and wherein no detectable level of activated activatable antibody in the subject or biological sample indicates that the cleaving agent is present in the subject or biological sample at a detectable level.

The disclosure provides methods of detecting presence or absence of a cleaving agent and the target in a subject or a sample by (i) contacting a subject or biological sample with an activatable antibody, wherein the activatable antibody includes a detectable label that is positioned on a portion of the activatable antibody that is released following cleavage of the CM and (ii) measuring a level of activated activatable antibody in the subject or biological sample, wherein a detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample, and wherein a reduced detectable level of activated activatable antibody in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%. Such an activatable antibody includes a masking moiety (MM), a cleavable moiety (CM) that is cleaved by the cleaving agent, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent and the target in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein a detectable level of activated activatable antibody in the subject or biological sample indicates that the cleaving agent, the target or both the cleaving agent and the target are absent and/or not sufficiently present in the subject or biological sample, such that the target binding and/or protease cleavage of the activatable antibody cannot be detected in the subject or biological sample, and wherein a reduced detectable level of activated activatable antibody in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%.

The disclosure also provides methods of detecting presence or absence of a cleaving agent in a subject or a sample by (i) contacting a subject or biological sample with an activatable antibody, wherein the activatable antibody includes a detectable label that is positioned on a portion of the activatable antibody that is released following cleavage of the CM; and (ii) measuring a level of detectable label in the subject or biological sample, wherein a detectable level of the detectable label in the subject or biological sample indicates that the cleaving agent is absent and/or not sufficiently present in the subject or biological sample at a detectable level, such that protease cleavage of the activatable antibody cannot be detected in the subject or biological sample, and wherein a reduced detectable level of the detectable label in the subject or biological sample indicates that the cleaving agent is present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%. Such an activatable antibody includes a masking moiety (MM), a cleavable moiety (CM) that is cleaved by the cleaving agent, and an antigen binding domain or fragment thereof (AB) that specifically binds the target, wherein the activatable antibody in an uncleaved (i.e., non-activated) state comprises a structural arrangement from N-terminus to C-terminus as follows: MM-CM-AB or AB-CM-MM; (a) wherein the MM is a peptide that inhibits binding of the AB to the target, and wherein the MM does not have an amino acid sequence of a naturally occurring binding partner of the AB; and (b) wherein the MM of the activatable antibody in an uncleaved state interferes with specific binding of the AB to the target, and wherein the MM of an activatable antibody in a cleaved (i.e., activated) state does not interfere or compete with specific binding of the AB to the target. In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

The disclosure also provides kits for use in methods of detecting presence or absence of a cleaving agent of interest in a subject or a sample, where the kits include at least an activatable antibody and/or conjugated activatable antibody described herein for use in contacting a subject or biological sample and means for detecting the level of activated activatable antibody and/or conjugated activatable antibody in the subject or biological sample, wherein the activatable antibody includes a detectable label that is positioned on a portion of the activatable antibody that is released following cleavage of the CM, wherein a detectable level of the detectable label in the subject or biological sample indicates that the cleaving agent, the target, or both the cleaving agent and the target are absent and/or not sufficiently present in the subject or biological sample, such that the target binding and/or protease cleavage of the activatable antibody cannot be detected in the subject or biological sample, and wherein a reduced detectable level of the detectable label in the subject or biological sample indicates that the cleaving agent and the target are present in the subject or biological sample. A reduced level of detectable label is, for example, a reduction of about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95% and/or about 100%.

In some embodiments of these methods and kits, the activatable antibody includes a detectable label. In some embodiments of these methods and kits, the detectable label includes an imaging agent, a contrasting agent, an enzyme, a fluorescent label, a chromophore, a dye, one or more metal ions, or a ligand-based label. In some embodiments of these methods and kits, the imaging agent comprises a radioisotope. In some embodiments of these methods and kits, the radioisotope is indium or technetium. In some embodiments of these methods and kits, the contrasting agent comprises iodine, gadolinium or iron oxide. In some embodiments of these methods and kits, the enzyme comprises horseradish peroxidase, alkaline phosphatase, or β-galactosidase. In some embodiments of these methods and kits, the fluorescent label comprises yellow fluorescent protein (YFP), cyan fluorescent protein (CFP), green fluorescent protein (GFP), modified red fluorescent protein (mRFP), red fluorescent protein tdimer2 (RFP tdimer2), HCRED, or a europium derivative. In some embodiments of these methods and kits, the luminescent label comprises an N-methylacrydium derivative. In some embodiments of these methods, the label comprises an Alexa Fluor® label, such as Alex Fluor® 680 or Alexa Fluor®750. In some embodiments of these methods and kits, the ligand-based label comprises biotin, avidin, streptavidin or one or more haptens.

In some embodiments of these methods and kits, the subject is a mammal. In some embodiments of these methods and kits, the subject is a human. In some embodiments, the subject is a non-human mammal, such as a non-human primate, companion animal (e.g., cat, dog, horse), farm animal, work animal, or zoo animal. In some embodiments, the subject is a rodent.

In some embodiments of these methods, the method is an in vivo method. In some embodiments of these methods, the method is an in situ method. In some embodiments of these methods, the method is an ex vivo method. In some embodiments of these methods, the method is an in vitro method.

In some embodiments, in situ imaging and/or in vivo imaging are useful in methods to identify which patients to treat. For example, in in situ imaging, the activatable antibodies are used to screen patient samples to identify those patients having the appropriate protease(s) and target(s) at the appropriate location, e.g., at a tumor site.

In some embodiments in situ imaging is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative for either or both of the target (e.g., the target) and the protease that cleaves the substrate in the CM in the activatable antibody being tested using these methods might be identified as suitable candidates for another form of therapy. In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease). In some embodiments, the patient is then administered a therapeutically effective amount of the activatable antibody for which the patient tested positive.

In some embodiments in vivo imaging is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative might be identified as suitable candidates for another form of therapy. In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease). In some embodiments, the patient is then administered a therapeutically effective amount of the activatable antibody for which the patient tested positive.

In some embodiments of the methods and kits, the method or kit is used to identify or otherwise refine a patient population suitable for treatment with an activatable antibody of the disclosure. For example, patients that test positive for both the target (e.g., the target) and a protease that cleaves the substrate in the cleavable moiety (CM) of the activatable antibody being tested in these methods are identified as suitable candidates for treatment with such an activatable antibody comprising such a CM. Likewise, patients that test negative for both of the targets (e.g., the target) and the protease that cleaves the substrate in the CM in the activatable antibody being tested using these methods might be identified as suitable candidates for another form of therapy. In some embodiments, such patients can be tested with other activatable antibodies until a suitable activatable antibody for treatment is identified (e.g., an activatable antibody comprising a CM that is cleaved by the patient at the site of disease). In some embodiments, patients that test negative for either of the target (e.g., the target) are identified as suitable candidates for treatment with such an activatable antibody comprising such a CM. In some embodiments, patients that test negative for either of the target (e.g., the target) are identified as not being suitable candidates for treatment with such an activatable antibody comprising such a CM. In some embodiments, such patients can be tested with other activatable antibodies until a suitable activatable antibody for treatment is identified (e.g., an activatable antibody comprising a CM that is cleaved by the patient at the site of disease). In some embodiments, the activatable antibody is an activatable antibody to which a therapeutic agent is conjugated. In some embodiments, the activatable antibody is not conjugated to an agent. In some embodiments, the activatable antibody comprises a detectable label. In some embodiments, the detectable label is positioned on the AB. In some embodiments, measuring the level of activatable antibody in the subject or sample is accomplished using a secondary reagent that specifically binds to the activated antibody, wherein the reagent comprises a detectable label. In some embodiments, the secondary reagent is an antibody comprising a detectable label.

In some embodiments, a method or kit is used to identify or otherwise refine a patient population suitable for treatment with an anti-the target activatable antibody and/or conjugated activatable antibody (e.g., activatable antibody to which a therapeutic agent is conjugated) of the disclosure, followed by treatment by administering that activatable antibody and/or conjugated activatable antibody to a subject in need thereof. For example, patients that test positive for both the targets (e.g., the target) and a protease that cleaves the substrate in the cleavable moiety (CM) of the activatable antibody and/or conjugated activatable antibody being tested in these methods are identified as suitable candidates for treatment with such antibody and/or such a conjugated activatable antibody comprising such a CM, and the patient is then administered a therapeutically effective amount of the activatable antibody and/or conjugated activatable antibody that was tested. Likewise, patients that test negative for either or both of the target (e.g., the target) and the protease that cleaves the substrate in the CM in the activatable antibody being tested using these methods might be identified as suitable candidates for another form of therapy. In some embodiments, such patients can be tested with other antibody and/or conjugated activatable antibody until a suitable antibody and/or conjugated activatable antibody for treatment is identified (e.g., an activatable antibody and/or conjugated activatable antibody comprising a CM that is cleaved by the patient at the site of disease). In some embodiments, the patient is then administered a therapeutically effective amount of the activatable antibody and/or conjugated activatable antibody for which the patient tested positive.

In some embodiments of these methods and kits, the MM is a peptide having a length from about 4 to 40 amino acids. In some embodiments of these methods and kits, the activatable antibody comprises a linker peptide, wherein the linker peptide is positioned between the MM and the CM. In some embodiments of these methods and kits, the activatable antibody comprises a linker peptide, where the linker peptide is positioned between the AB and the CM. In some embodiments of these methods and kits, the activatable antibody comprises a first linker peptide (L1) and a second linker peptide (L2), wherein the first linker peptide is positioned between the MM and the CM and the second linker peptide is positioned between the AB and the CM. In some embodiments of these methods and kits, each of L1 and L2 is a peptide of about 1 to 20 amino acids in length, and wherein each of L1 and L2 need not be the same linker. In some embodiments of these methods and kits, one or both of L1 and L2 comprises a glycine-serine polymer. In some embodiments of these methods and kits, at least one of L1 and L2 comprises an amino acid sequence selected from the group consisting of (GS)n, (GSGGS)n (SEQ ID NO: 363) and (GGGS)n (SEQ ID NO: 364), where n is an integer of at least one. In some embodiments of these methods and kits, at least one of L1 and L2 comprises an amino acid sequence having the formula (GGS)n, where n is an integer of at least one. In some embodiments of these methods and kits, at least one of L1 and L2 comprises an amino acid sequence selected from the group consisting of GGSG (SEQ ID NO: 365), GGSGG (SEQ ID NO: 366), GSGSG (SEQ ID NO: 367), GSGGG (SEQ ID NO: 368), GGGSG (SEQ ID NO: 369), and GSSSG (SEQ ID NO: 370).

In some embodiments of these methods and kits, the AB comprises an antibody or antibody fragment sequence selected from the cross-reactive antibody sequences presented herein. In some embodiments of these methods and kits, the AB comprises a Fab fragment, a scFv or a single chain antibody (scAb).

In some embodiments of these methods and kits, the cleaving agent is a protease that is co-localized in the subject or sample with the target and the CM is a polypeptide that functions as a substrate for the protease, wherein the protease cleaves the CM in the activatable antibody when the activatable antibody is exposed to the protease. In some embodiments of these methods and kits, the CM is a polypeptide of up to 15 amino acids in length. In some embodiments of these methods and kits, the CM is coupled to the N-terminus of the AB. In some embodiments of these methods and kits, the CM is coupled to the C-terminus of the AB. In some embodiments of these methods and kits, the CM is coupled to the N-terminus of a VL chain of the AB.

The antibodies and/or activatable antibodies of the disclosure are used in diagnostic and prophylactic formulations. In one embodiment, an activatable antibody is administered to patients that are at risk of developing one or more of the aforementioned inflammation, inflammatory disorders, cancer or other disorders.

A patient's or organ's predisposition to one or more of the aforementioned disorders can be determined using genotypic, serological or biochemical markers.

In some embodiments of the disclosure, an antibody and/or an activatable antibody is administered to human individuals diagnosed with a clinical indication associated with one or more of the aforementioned disorders. Upon diagnosis, an antibody and/or an activatable antibody is administered to mitigate or reverse the effects of the clinical indication.

Antibodies and/or activatable antibodies of the disclosure are also useful in the detection of the target in patient samples and accordingly are useful as diagnostics. For example, the antibodies and/or activatable antibodies of the disclosure are used in in vitro assays, e.g., ELISA, to detect target levels in a patient sample.

In some embodiments, anti-PDL1 antibodies are used as a diagnostic for patients who are more likely to respond favorably to treatment with an anti-PD-1 antibody and/or activatable antibody of the disclosure. In these embodiments, PD-L1 expression in tumor biopsies on both tumor cells and infiltrating immune cells and PD-L1 expression on immune cells in blood are used to indicate the presence of active immunity and, thus, potential for suppression of T cell activity through the engagement of PD-1 by PD-L1.

In one embodiment, an antibody and/or activatable antibody of the disclosure is immobilized on a solid support (e.g., the well(s) of a microtiter plate). The immobilized antibody and/or activatable antibody serves as a capture antibody for any target that can be present in a test sample. Prior to contacting the immobilized antibody and/or activatable antibody with a patient sample, the solid support is rinsed and treated with a blocking agent such as milk protein or albumin to prevent nonspecific adsorption of the analyte.

Subsequently the wells are treated with a test sample suspected of containing the antigen, or with a solution containing a standard amount of the antigen. Such a sample is, e.g., a serum sample from a subject suspected of having levels of circulating antigen considered to be diagnostic of a pathology. After rinsing away the test sample or standard, the solid support is treated with a second antibody that is detectably labeled. The labeled second antibody serves as a detecting antibody. The level of detectable label is measured, and the concentration of target antigen in the test sample is determined by comparison with a standard curve developed from the standard samples.

It will be appreciated that based on the results obtained using the antibodies and/or activatable antibodies of the disclosure in an in vitro diagnostic assay, it is possible to stage a disease in a subject based on expression levels of the target antigen. For a given disease, samples of blood are taken from subjects diagnosed as being at various stages in the progression of the disease, and/or at various points in the therapeutic treatment of the disease. Using a population of samples that provides statistically significant results for each stage of progression or therapy, a range of concentrations of the antigen that can be considered characteristic of each stage is designated.

Antibodies, conjugated antibodies, activatable antibodies and/or conjugated activatable antibodies can also be used in diagnostic and/or imaging methods. In some embodiments, such methods are in vitro methods. In some embodiments, such methods are in vivo methods. In some embodiments, such methods are in situ methods. In some embodiments, such methods are ex vivo methods. For example, activatable antibodies having an enzymatically cleavable CM can be used to detect the presence or absence of an enzyme that is capable of cleaving the CM. Such activatable antibodies can be used in diagnostics, which can include in vivo detection (e.g., qualitative or quantitative) of enzyme activity (or, in some embodiments, an environment of increased reduction potential such as that which can provide for reduction of a disulfide bond) through measured accumulation of activated antibodies (i.e., antibodies resulting from cleavage of an activatable antibody) in a given cell or tissue of a given host organism. Such accumulation of activated antibodies indicates not only that the tissue expresses enzymatic activity (or an increased reduction potential depending on the nature of the CM) but also that the tissue expresses target to which the activated antibody binds.

For example, the CM can be selected to be a protease substrate for a protease found at the site of a tumor, at the site of a viral or bacterial infection at a biologically confined site (e.g., such as in an abscess, in an organ, and the like), and the like. The AB can be one that binds a target antigen. Using methods familiar to one skilled in the art, a detectable label (e.g., a fluorescent label or radioactive label or radiotracer) can be conjugated to an AB or other region of an activatable antibody. Suitable detectable labels are discussed in the context of the above screening methods and additional specific examples are provided below. Using an AB specific to a protein or peptide of the disease state, along with a protease whose activity is elevated in the disease tissue of interest, activatable antibodies will exhibit an increased rate of binding to disease tissue relative to tissues where the CM specific enzyme is not present at a detectable level or is present at a lower level than in disease tissue or is inactive (e.g., in zymogen form or in complex with an inhibitor). Since small proteins and peptides are rapidly cleared from the blood by the renal filtration system, and because the enzyme specific for the CM is not present at a detectable level (or is present at lower levels in non-disease tissues or is present in inactive conformation), accumulation of activated antibodies in the disease tissue is enhanced relative to non-disease tissues.

In another example, activatable antibodies can be used to detect the presence or absence of a cleaving agent in a sample. For example, where the activatable antibodies contain a CM susceptible to cleavage by an enzyme, the activatable antibodies can be used to detect (either qualitatively or quantitatively) the presence of an enzyme in the sample. In another example, where the activatable antibodies contain a CM susceptible to cleavage by reducing agent, the activatable antibodies can be used to detect (either qualitatively or quantitatively) the presence of reducing conditions in a sample. To facilitate analysis in these methods, the activatable antibodies can be detectably labeled, and can be bound to a support (e.g., a solid support, such as a slide or bead). The detectable label can be positioned on a portion of the activatable antibody that is not released following cleavage, for example, the detectable label can be a quenched fluorescent label or other label that is not detectable until cleavage has occurred. The assay can be conducted by, for example, contacting the immobilized, detectably labeled activatable antibodies with a sample suspected of containing an enzyme and/or reducing agent for a time sufficient for cleavage to occur, then washing to remove excess sample and contaminants. The presence or absence of the cleaving agent (e.g., enzyme or reducing agent) in the sample is then assessed by a change in detectable signal of the activatable antibodies prior to contacting with the sample e.g., the presence of and/or an increase in detectable signal due to cleavage of the activatable antibody by the cleaving agent in the sample.

Such detection methods can be adapted to also provide for detection of the presence or absence of a target that is capable of binding the AB of the activatable antibodies when cleaved. Thus, the assays can be adapted to assess the presence or absence of a cleaving agent and the presence or absence of a target of interest. The presence or absence of the cleaving agent can be detected by the presence of and/or an increase in detectable label of the activatable antibodies as described above, and the presence or absence of the target can be detected by detection of a target-AB complex e.g., by use of a detectably labeled anti-target antibody.

Activatable antibodies are also useful in in situ imaging for the validation of activatable antibody activation, e.g., by protease cleavage, and binding to a particular target. In situ imaging is a technique that enables localization of proteolytic activity and target in biological samples such as cell cultures or tissue sections. Using this technique, it is possible to confirm both binding to a given target and proteolytic activity based on the presence of a detectable label (e.g., a fluorescent label).

These techniques are useful with any frozen cells or tissue derived from a disease site (e.g. tumor tissue) or healthy tissues. These techniques are also useful with fresh cell or tissue samples.

In these techniques, an activatable antibody is labeled with a detectable label. The detectable label can be a fluorescent dye, (e.g. Fluorescein Isothiocyanate (FITC), Rhodamine Isothiocyanate (TRITC), a near infrared (NIR) dye (e.g., Qdot® nanocrystals), a colloidal metal, a hapten, a radioactive marker, biotin and an amplification reagent such as streptavidin, or an enzyme (e.g. horseradish peroxidase or alkaline phosphatase).

Detection of the label in a sample that has been incubated with the labeled, activatable antibody indicates that the sample contains the target and contains a protease that is specific for the CM of the activatable antibody. In some embodiments, the presence of the protease can be confirmed using broad spectrum protease inhibitors such as those described herein, and/or by using an agent that is specific for the protease, for example, an antibody such as A11, which is specific for the protease matriptase and inhibits the proteolytic activity of matriptase; see e.g., International Publication Number WO 2010/129609, published 11 Nov. 2010. The same approach of using broad spectrum protease inhibitors such as those described herein, and/or by using a more selective inhibitory agent can be used to identify a protease or class of proteases specific for the CM of the activatable antibody. In some embodiments, the presence of the target can be confirmed using an agent that is specific for the target, e.g., another antibody, or the detectable label can be competed with unlabeled target. In some embodiments, unlabeled activatable antibody could be used, with detection by a labeled secondary antibody or more complex detection system.

Similar techniques are also useful for in vivo imaging where detection of the fluorescent signal in a subject, e.g., a mammal, including a human, indicates that the disease site contains the target and contains a protease that is specific for the CM of the activatable antibody.

These techniques are also useful in kits and/or as reagents for the detection, identification or characterization of protease activity in a variety of cells, tissues, and organisms based on the protease-specific CM in the activatable antibody.

In some embodiments, in situ imaging and/or in vivo imaging are useful in methods to identify which patients to treat. For example, in in situ imaging, the activatable antibodies are used to screen patient samples to identify those patients having the appropriate protease(s) and target(s) at the appropriate location, e.g., at a tumor site.

In some embodiments in situ imaging is used to identify or otherwise refine a patient population suitable for treatment with an activatable antibody of the disclosure. For example, patients that test positive for both the target and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative for either or both of the target and the protease that cleaves the substrate in the CM in the activatable antibody being tested using these methods are identified as suitable candidates for another form of therapy (i.e., not suitable for treatment with the activatable antibody being tested). In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease).

In some embodiments in vivo imaging is used to identify or otherwise refine a patient population suitable for treatment with an activatable antibody of the disclosure. For example, patients that test positive for both the target and a protease that cleaves the substrate in the cleavable moiety (CM) of the activatable antibody being tested (e.g., accumulate activated antibodies at the disease site) are identified as suitable candidates for treatment with such an activatable antibody comprising such a CM. Likewise, patients that test negative are identified as suitable candidates for another form of therapy (i.e., not suitable for treatment with the activatable antibody being tested). In some embodiments, such patients that test negative with respect to a first activatable antibody can be tested with other activatable antibodies comprising different CMs until a suitable activatable antibody for treatment is identified (e.g., an activatable antibody comprising a CM that is cleaved by the patient at the site of disease).

Pharmaceutical Compositions

The antibodies and/or activatable antibodies of the disclosure (also referred to herein as "active compounds"), and derivatives, fragments, analogs and homologs thereof, can be incorporated into pharmaceutical compositions suitable for administration. Such compositions typically comprise the antibody and/or activatable antibody and a pharmaceutically acceptable carrier. As used herein, the term "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Suitable examples of such carriers or diluents include, but are not limited to, water, saline, ringer's solutions, dextrose solution, and 5% human serum albumin. Liposomes and non-aqueous vehicles such as fixed oils can also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the disclosure is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In some embodiments, it will be desirable to include isotonic agents, for example, sugars, polyalcohols such as manitol, sorbitol, sodium chloride in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser that contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser together with instructions for administration.

The invention will be further described in the following examples, which do not limit the scope of the invention described in the claims.

EXAMPLES

Example 1. Generation of Mouse Antibodies of the Embodiments that Bind Human PD-1 and Block hPD-L1 and hPD-L2 Binding to Human PD-1

This example demonstrates mouse antibodies of the disclosure that bind human PD-1 can be isolated from hybridomas derived from mouse immunization with recombinant human PD-1 protein, and that such binding can inhibit PD-1 binding to PDL1 and PDL2.

Six NZBWFi/J female mice (Jackson Laboratories, Sacramento, Calif.; cat#100008) were immunized in the right flank with recombinant human PD-1 (Sino Biological, Beijing, P.R. China; cat# ABIN2181605) on days 0, 7 and 21. Serum was taken from immunized mice on day 28 and binding to HEK293-hPD-1 (cells transfected with an expression vector encoding human PD-1 (Origene, cat# SC117011)) was measured. All six mice showed positive binding. Splenocytes were isolated from mouse 1, 3 and 6 and fused with SP0 mouse B-cells; likewise splenocytes were isolated from mouse 2, 4 and 5 and fused with SP0 mouse B-cells, giving rise to pools of hybridomas, m136 and m245. The hybridoma pools, m136 and m245, arising from the two fusions were plated for single clones, and clonal culture supernatants were assayed for antibodies capable of binding to HEK293-hPD-1, and not to un-transfected HEK293, cells. Hybridoma clones expressing anti-PD-1 antibodies were chosen for further analysis.

The sequences of the antibodies used in the studies presented herein are shown below:

m136-M13—MHC723 mIgG1/K
MHC723HC.1 Variable Heavy Chain Region Amino Acid Sequence:

(SEQ ID NO: 1)
EVKLVESGGGLVKPGGSLKLSCAAS<u>GFTFSGYAMS</u>WVRQTPAKRLEWVA<u>Y</u>

<u>ISNSGGNAH</u>YPDSVKGRFTISRDNAKNTLYLQMSSLRSEDTAMYYCT<u>RED</u>

<u>YGTSPFVY</u>WGQGTLVTVSA

MHC723HC.1 Variable Heavy Chain Region Nucleic Acid Sequence:

(SEQ ID NO: 2)
GAAGTGAAGCTGGTGGAGTCTGGGGGAGGCTTAGTGAAACCTGGAGGGTC

CCTGAAACTCTCCTGTGCAGCCTCTGGATTCACTTTCAGTGGCTATGCCA

TGTCTTGGGTTCGCCAGACTCCGGCGAAGAGGCTGGAGTGGGTCGCATAC

ATTAGTAATAGTGGTGGTAACGCCCACTATCCAGACAGTGTAAAGGGCCG

ATTCACCATCTCCAGAGACAATGCCAAGAACACCCTATACCTGCAAATGA

GCAGTCTGAGGTCTGAGGACACGGCCATGTATTACTGTACAAGAGAGGAC

TACGGTACTAGTCCTTTTGTTTACTGGGGCCAAGGGACTCTGGTCACTGT

CTCTGCA

MHC723LC.3 Variable Light Chain Region Amino Acid Sequence:

(SEQ ID NO: 3)
DIVLTQSPASLAVSLGQRTTISC<u>RASESVDNYGISFMN</u>WFQQKPGQPPKL

LIY<u>AASNQGS</u>GVPARFSGSGSGTDFSLNIHPMEEDDTAVYFC<u>QQSKDVPW</u>

<u>T</u>FGGGTKLEIR

MHC723LC.3 Variable Light Chain Region Nucleic Acid Sequence:

(SEQ ID NO: 4)
GACATTGTGCTGACCCAATCTCCAGCTTCTTTGGCTGTGTCTCTTGGGCA

GAGGACCACCATCTCCTGCAGAGCCAGCGAAAGTGTTGATAATTATGGCA

TTAGTTTTATGAACTGGTTCCAACAGAAACCAGGACAGCCACCCAAACTC

CTCATCTATGCTGCATCCAACCAAGGATCCGGGGTCCCTGCCAGGTTTAG

TGGCAGTGGGTCTGGGACAGACTTCAGCCTCAACATCCATCCTATGGAGG

AGGATGATACTGCAGTGTATTTCTGTCAGCAAAGTAAGGACGTTCCGTGG

ACGTTCGGTGGAGGCACCAAGCTGGAAATCAGAC m136-M19—MHC725 mIgG2b/K
MHC725HC.2 Variable Heavy Chain Region Amino Acid Sequence:

(SEQ ID NO: 5)
EVQLQQSGPELVKPGDSVKMSCKAS<u>GYTFTDYYMD</u>WVKQSHGKSLEWIG<u>Y</u>

<u>IYPKNGGS</u>SYNQKFKGKATLTVDKSSSTAYMELHSLTSEDSAVYYCAR<u>KV</u>

<u>VATDY</u>WGQGTTLTVSS

MHC725HC.2 Variable Heavy Chain Region Nucleic Acid Sequence:

(SEQ ID NO: 6)
GAGGTCCAGCTGCAACAGTCTGGACCTGAGCTGGTGAAGCCTGGGGATTC

AGTGAAGATGTCCTGCAAGGCTTCTGGCTACACATTCACTGACTACTACA

TGGACTGGGTGAAGCAGAGCCATGGAAAGAGCCTTGAGTGGATTGGATAA

TTTATCCTAAAAATGGTGGTTCCAGCTACAATCAGAAGTTCAAGGGCAAG

CCACATTGACTGTAGACAAGTCCTCCAGCACAGCCTACATGGAGCTCACA

GCCTGACATCTGAGGACTCTGCAGTCTATTACTGTGCAAGAAAGGCGTAG

CTACGGACTACTGGGGCCAAGGCACCACTCTCACAGTCTCCTCA

MHC725LC.2 Variable Light Chain Region Amino Acid Sequence:

(SEQ ID NO: 7)
DIVMSQSPSSLAVSVGEKVTMSC<u>KSSQSLLYSSNQKNYL</u>AWYQQKPGQSP

KLLIF<u>WASIRES</u>GVPDRFTGSGSGTDFTLTISSVKAEDRAVYYC<u>QQCDSY</u>

<u>PWT</u>FGGGTKLEIK

MHC725LC.2 Variable Light Chain Region Nucleic Acid Sequence:

(SEQ ID NO: 8)
GACATTGTGATGTCACAGTCTCCATCCTCCCTAGCTGTGTCAGTTGGAGA

GAAGGTTACTATGAGCTGCAAGTCCAGTCAGAGCCTTTTATATAGTAGCA

ATCAAAAGAACTACTTGGCCTGGTACCAGCAGAAACCAGGGCAGTCTCCT

AAACTGCTGATTTTCTGGGCATCTATTAGGGAATCTGGGGTCCCTGATCG

CTTCACAGGCAGTGGATCTGGGACAGATTTCACTCTCACCATCAGCAGTG

TGAAGGCTGAAGACCGGGCAGTTTATTACTGTCAGCAATGTGATAGCTAT

CCGTGGACGTTCGGTGGAGGCACCAAACTGGAAATCAAAC m245-M3—MHC728 mIgG2a/K
MHC728HC.4 Variable Heavy Chain Region Amino Acid Sequence:

(SEQ ID NO: 9)
EVKLVESGGGLVKPGGSLKLSCAAS<u>GFTFSNYAMS</u>WVRQTPAKRLEWVA<u>Y</u>

<u>ISNGGGDTHYPDSLKGR</u>FTVSRDNAKNTLYLQMSSLKSEDTAMYYCAR<u>EN</u>

<u>YGTSPFVY</u>WGQGTLVTVSA

MHC728HC.4 Variable Heavy Chain Region Nucleic Acid Sequence:

(SEQ ID NO: 10)
GAAGTGAAGCTGGTGGAGTCTGGGGGAGGCTTAGTGAAACCTGGAGGGTC

CCTGAAACTCTCCTGTGCAGCCTCTGGATTCACTTTCAGTAACTATGCCA

TGTCTTGGGTTCGCCAGACTCCGGCGAAGAGGCTGGAGTGGGTCGCATAC

ATTAGTAATGGTGGTGGTGACACCCACTATCCAGACAGTTTAAAGGGCCG

ATTCACCGTCTCCAGAGACAATGCCAAGAACACCCTGTACCTACAAATGA

GCAGTCTGAAGTCTGAGGACACGGCCATGTATTACTGTGCAAGAGAAAAC

TACGGTACTAGTCCCTTTGTTTACTGGGGCCAAGGGACTCTGGTCACTGT

CTCTGCA

MHC728LC.2 Variable Light Chain Region Amino Acid Sequence:

(SEQ ID NO: 11)
DIVLTQSPASLAVSLGQRATISC<u>RASESVDNYGISFMN</u>WFQQKPGQPPKL

LIY<u>AASNQGS</u>GVPARFSGSGSGTDFSLNIHPMEEDDTAMYFC<u>QQSKDVPW</u>

<u>T</u>FGGGTKLEIK

MHC728LC.2 Variable Light Chain Region Nucleic Acid Sequence:

(SEQ ID NO: 12)
GACATTGTGCTGACCCAATCTCCAGCTTCTTTGGCTGTGTCTCTAGGGCA

GAGGGCCACCATCTCCTGCAGAGCCAGCGAAAGTGTTGATAATTATGGCA

TTAGTTTTATGAACTGGTTCCAACAGAAACCAGGACAGCCACCCAAACTC

CTCATCTATGCTGCATCCAACCAAGGATCCGGGGTCCCTGCCAGGTTTAG

TGGCAGTGGGTCTGGGACAGACTTCAGCCTCAACATCCATCCTATGGAGG

AGGATGATACTGCAATGTATTTCTGTCAGCAAAGTAAAGATGTTCCGTGG

ACGTTCGGTGGAGGCACCAAGCTGGAAATCAAAC m245-M5—MHC729 mIgG1/K
MHC729HC.1 Variable Heavy Chain Region Amino Acid Sequence:

(SEQ ID NO: 13)
EVQLVESGGGLVKSGGSLKLSCAHS<u>GFSFSSYDMS</u>WVRQTPAKRLEWVA<u>T</u>

<u>ISGGGRYTY</u>YPDSVKGRFTISRDNAKNTLYLQMSGLRSEDTAMYYCAS<u>NY</u>

<u>YGFDY</u>WGQGTTLTVSS

MHC729HC.1 Variable Heavy Chain Region Nucleic Acid Sequence:

(SEQ ID NO: 14)
GAAGTGCAGCTGGTGGAGTCTGGGGGAGGCTTAGTGAAGTCTGGAGGGTC

CCTGAAACTCTCCTGTGCGCATTCTGGATTCAGTTTTAGTAGTTATGACA

TGTCTTGGGTTCGCCAGACTCCGGCGAAGAGGCTGGAGTGGGTCGCAACC

ATTAGTGGTGGTGGTCGTTACACCTACTATCCAGACAGTGTGAAGGGCCG

ATTCACCATCTCCAGAGACAATGCCAAGAACACCCTGTACCTGCAAATGA

GCGGTCTGAGGTCTGAGGACACAGCCATGTATTACTGTGCAAGTAATTAC

TACGGTTTTGACTACTGGGGCCAAGGCACCACTCTCACAGTCTCTTCA

MHC729LC.3 Variable Light Chain Region Amino Acid Sequence:

(SEQ ID NO: 15)
DIVMTQSHKFMSTSVGDRVSITC<u>KASQDVGTAVA</u>WYQQKPGQSPKLLIY<u>W</u>

<u>ASTRHT</u>GVPDRFTGSGSGTDFTLTISNVQSEDLADYFC<u>QQYSSYPWT</u>FGG

GTKLEIK

MHC729LC.3 Variable Light Chain Region Nucleic Acid Sequence:

(SEQ ID NO: 16)
GATATTGTGATGACCCAGTCTCACAAATTCATGTCCACATCAGTAGGAGA

CAGGGTCAGCATCACCTGCAAGGCCAGTCAGGATGTGGGTACTGCTGTAG

CCTGGTATCAACAGAAACCAGGGCAATCTCCTAAACTACTGATTTACTGG

GCATCCACCCGGCACACTGGAGTCCCTGATCGCTTCACGGGCAGTGGATC

TGGGACAGATTTCACTCTCACCATTAGCAATGTGCAGTCTGAAGACTTGG

CAGATTATTTCTGTCAGCAATATAGCAGCTATCCGTGGACGTTCGGTGGA

GGCACCAAGCTGGAAATCAAAC m136-M14—MHC724 mIgG2a/K
MHC724HC.3 Variable Heavy Chain Region Amino Acid Sequence:

(SEQ ID NO: 17)
KVMLVESGGDLVKPGGSLKLSCAAS<u>GFTFSSYGMS</u>WVRQTPEKRLEWVA<u>T</u>

<u>ISGGGRDIY</u>YADTVKGRFTISRDNAKNTLYLQMSSLRSEDTALYFCAR<u>LY</u>

<u>LGFDY</u>WGQGTTLTVSS

MHC724HC.3 Variable Heavy Chain Region Nucleic Acid Sequence:

(SEQ ID NO: 18)
AAAGTGATGCTGGTGGAGTCTGGGGGAGACTTAGTGAAGCCTGGAGGGTC

CCTGAAACTCTCCTGTGCAGCCTCTGGATTCACTTTCAGTAGCTATGGCA

TGTCTTGGGTTCGCCAGACTCCGGAGAAGAGGCTGGAGTGGGTCGCAACC

ATTAGTGGTGGTGGTAGAGACATCTACTACGCAGACACTGTGAAGGGCCG

ATTCACCATCTCCAGAGACAATGCCAAGAACACCCTGTACCTACAAATGA

GCAGTCTGAGGTCTGAGGACACGGCCTTGTATTTCTGTGCAAGGCTCTAC

CTGGGGTTTGACTACTGGGGCCAAGGCACCACTCTCACAGTCTCCTCA

MHC724LC.1 Variable Light Chain Region Amino Acid Sequence:

(SEQ ID NO: 19)
DIQMTQSPASQSASLGESVTITC<u>LASQTIGTWLA</u>WYQQKPGKSPQLLIY<u>A</u>

<u>ATSLADGVPSRFSGSGSGTKFSFKISSLQAEDFVSYYCQQLYSIPWT</u>FGG

GTKLEIK

MHC724LC.1 Variable Light Chain Region Nucleic Acid Sequence:

(SEQ ID NO: 20)
GACATTCAGATGACCCAGTCTCCTGCCTCCCAGTCTGCATCTCTGGGAGA

AAGTGTCACCATCACATGCCTGGCAAGTCAGACCATTGGTACATGGTTAG

CATGGTATCAGCAGAAACCAGGGAAATCTCCTCAGCTCCTGATTTATGCT

GCAACCAGCTTGGCAGATGGGGTCCCATCAAGGTTCAGTGGTAGTGGATC

TGGCACAAAATTTTCTTTCAAGATCAGCAGCCTACAGGCTGAAGATTTTG

TAAGTTATTACTGTCAACAACTTTACAGTATTCCGTGGACATTCGGTGGA

GGCACCAAGCTGGAAATCAAAC

Binding of mouse antibodies m136-M13, m136-M19, m245-M3, m245-M5 and m136-M14 to human PD-1 was confirmed by ELISA (FIG. 1). Briefly, human PD-1-Fc (R and D systems, Minneapolis, Minn.) was adsorbed to the wells of a 96-well ELISA plate. Purified anti-PD-1 antibodies were applied to the plate in serial dilution and allowed to bind. Plates were washed with PBST (PBS, pH 7.2+0.05% Tween-20). Bound antibody was detected with an anti-mouse IgG-HRP conjugate (Sigma, St Louis, Mo.) and visualized with the chromogenic substrate TMB (Thermo Scientific, Rockford, Ill.). Plots were generated in Prizm (Sigma Plot) and the data were fit to a model of single site saturation binding. Anti-PD-1 antibodies nivolumab (NV1) and/or pembrolizumab (PM1) were used as positive controls in binding assays with anti-human IgG-HRP conjugate, FAb-specific (Sigma, St Louis, Mo.) for detection. The $K_d$ for each antibody tested is shown in Table 10 below:

TABLE 10

| $K_d$ values for tested antibodies: | |
|---|---|
| Clone | $K_d$, nM |
| 245-M3 | 0.22 |
| 245-M5 | 0.34 |

TABLE 10-continued

| $K_d$ values for tested antibodies: | |
|---|---|
| Clone | $K_d$, nM |
| 136-M13 | 0.19 |
| 136-M19 | 0.23 |
| 136-M14 | 0.19 |
| NV1 nivo | 0.28 |
| PM1 pembro | 0.35 |

Figure 2:
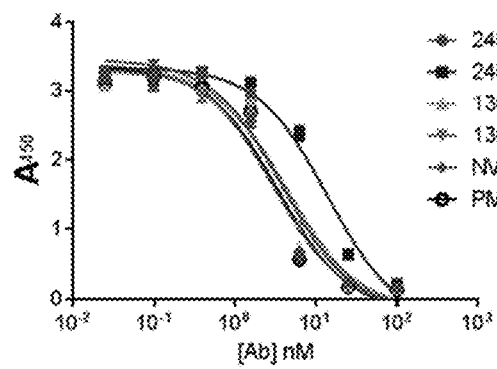
FIG. 2 is a series of graphs demonstrating that various murine anti-hPD-1 antibodies block binding of the ligands human PD-L1 (hPD-L1) and human PD-L2 (hPD-L2) to human PD-1.
Figure 2:
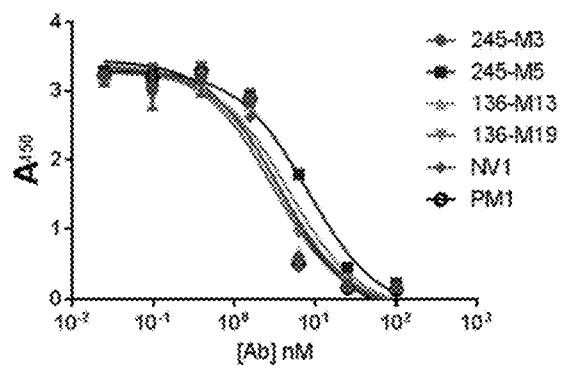
Figure 3:
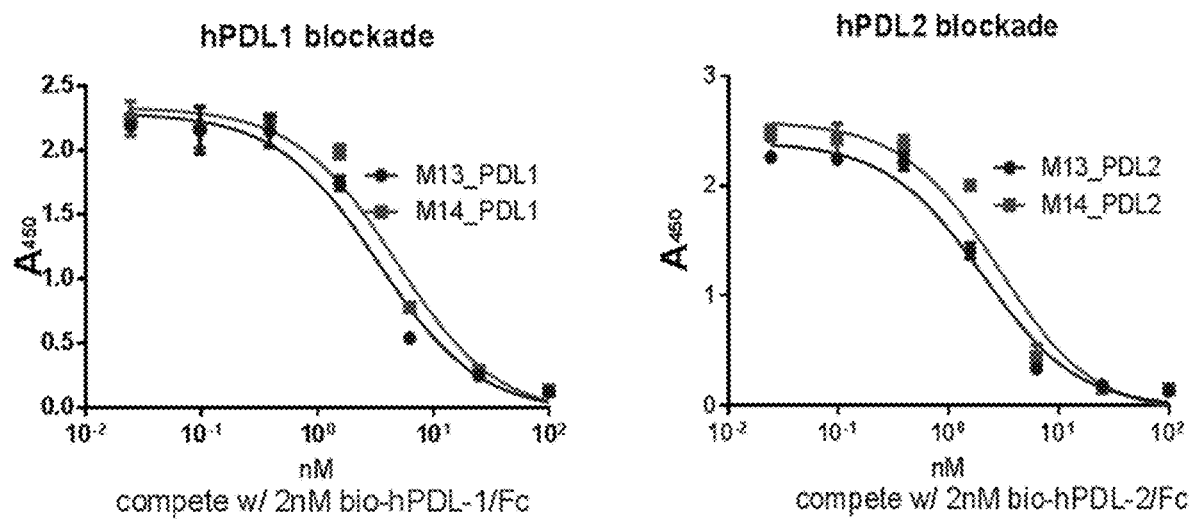
FIG. 3 is a series of graphs demonstrating that various murine anti-hPD-1 antibodies block binding of the ligands human PD-L1 (hPD-L1) and human PD-L2 (hPD-L2) to human PD-1.

Binding of mouse antibodies m136-M13, m136-M19, m245-M3, m245-M5 and m136-M14 to human PD-1 inhibited PD-1 binding to PDL1 and PDL2 in an inhibition ELISA assay (FIGS. 2-3). Inhibition ELISAs were performed as follows. Human PD-1-Fc (R and D systems, Minneapolis, Minn.) was adsorbed to the wells of a 96-well ELISA plate. Purified anti-PD-1 antibodies were applied to the plate in serial dilution in the presence of 2 nM biotinylated PD-L1 or 2 nM biotinylated PDL2. Binding of biotinylated PD-L1 and PD-L2 was detected by Pierce™ Streptavidin-poly HRP conjugate (Thermo Scientific, Rockford, Ill.) and visualized with TMB. Plots were generated in Prizm (Sigma Plot) and the data were fit to a model of single site competition binding and an $IC_{50}$ was determined. The $IC_{50}$ values for the M13 and M14 antibodies are shown in Table 11 below:

TABLE 11

| $IC_{50}$ values for antibodies tested | | |
|---|---|---|
| IC50 (nM) | hPDL1/Fc | hPDL2/Fc |
| M13 | 3.3 | 2 |
| M14 | 4.8 | 2.8 |

Example 2. Production and Testing of Humanized Anti-PD-1 Antibodies

This example demonstrates that mouse antibodies of the disclosure that bind human PD-1 can be converted to humanized IgG antibodies that retain PD-1 binding and inhibition of PDL1 and PDL2 binding to PD-1.

Variable domains of the mouse anti-PD-1 antibodies produced as described in Example 1 were humanized and expressed as full length hIgG4/hKappa antibodies. Fully human IgGs anti-PD-1 antibodies were expressed from transiently transfected HEK-293 cells and purified from the culture supernatant by Protein A chromatography.

The sequences of the humanized antibodies used in the studies presented herein are shown below:

PD-1 A Hv Variable Heavy Chain Region Amino Acid Sequence:

(SEQ ID NO: 21)
EVQLVESGGGLVQPGGSLRLSCAAS<u>GFTFSGYAMS</u>WVRQAPGKGLEWVA<u>Y</u>

<u>ISNSGGNAH</u>YADSVKGRFTISRDNSKNTLYLQMNSLRAEDTAVYYCTR<u>ED</u>

<u>YGTSPFVY</u>WGQGTLVTVSS

PD-1 A Hv Variable Heavy Chain Region Nucleic Acid Sequence:

(SEQ ID NO: 22)
GAAGTGCAGCTGGTGGAATCTGGCGGCGGACTGGTGCAGCCTGGCGGATC

TCTGAGACTGAGCTGTGCCGCCAGCGGCTTCACCTTTAGCGGCTACGCCA

TGAGCTGGGTGCGCCAGGCTCCTGGCAAAGGCCTGGAATGGGTGGCCTAC

ATCAGCAACAGCGGCGGCAATGCCCACTACGCCGATAGCGTGAAGGGCCG

GTTCACCATCAGCCGGGACAACAGCAAGAACACCCTGTACCTGCAGATGA

ACAGCCTGCGGGCCGAGGACACCGCCGTGTACTACTGCACCAGAGAGGAC

TACGGCACCAGCCCCTTCGTGTATTGGGGCCAGGGTACCCTCGTGACCGT

CTCCTCA

PD-1 Ab Hv Variable Heavy Chain Region Amino Acid Sequence:

(SEQ ID NO: 23)
EVQLVESGGGLVQPGGSLRLSCAAS<u>GFTFSGYAMS</u>WVRQAPGKGLEWVS<u>Y</u>

<u>ISNSGGNAH</u>YADSVKGRFTISRDNSKNTLYLQMNSLRAEDTAVYYCAK<u>ED</u>

<u>YGTSPFVY</u>WGQGTLVTVSS

PD-1 Ab Hv Variable Heavy Chain Region Nucleic Acid Sequence:

(SEQ ID NO: 24)
GAAGTGCAGCTGGTGGAATCTGGCGGCGGACTGGTGCAGCCTGGCGGATC

TCTGAGACTGAGCTGTGCCGCCAGCGGCTTCACCTTTAGCGGCTACGCCA

TGAGCTGGGTGCGCCAGGCTCCTGGCAAAGGCCTGGAATGGGTGAGTTAC

ATCAGCAACAGCGGCGGCAATGCCCACTACGCCGATAGCGTGAAGGGCCG

GTTCACCATCAGCCGGGACAACAGCAAGAACACCCTGTACCTGCAGATGA

ACAGCCTGCGGGCCGAGGACACCGCCGTGTACTACTGCGCCAAGGAGGAC

TACGGCACCAGCCCCTTCGTGTATTGGGGCCAGGGTACCCTCGTGACCGT

CTCCTCA

PD-1 Ae Hv Variable Heavy Chain Region Amino Acid Sequence:

(SEQ ID NO: 25)
EVQLVESGGGLVQPGGSLRLSCAAS<u>GFTFSGYAMS</u>WVRQAPGKGLEWVA<u>Y</u>

<u>ISNSGGNTH</u>YADSVKGRFTISRDNSKNTLYLQMNSLRAEDTAVYYCAR<u>ED</u>

<u>YGTSPFVY</u>WGQGTLVTVSS

PD-1 Ae Hv Variable Heavy Chain Region Nucleic Acid Sequence:

(SEQ ID NO: 26)
GAAGTGCAGCTGGTGGAATCTGGCGGCGGACTGGTGCAGCCTGGCGGATC

TCTGAGACTGAGCTGTGCCGCCAGCGGCTTCACCTTTAGCGGCTACGCCA

TGAGCTGGGTGCGCCAGGCTCCTGGCAAAGGCCTGGAATGGGTGGCCTAC

ATCAGCAACAGCGGCGGCAATACCCACTACGCCGATAGCGTGAAGGGCCG

GTTCACCATCAGCCGGGACAACAGCAAGAACACCCTGTACCTGCAGATGA

ACAGCCTGCGGGCCGAGGACACCGCCGTGTACTACTGCGCCAGAGAGGAC

TACGGCACCAGCCCCTTCGTGTATTGGGGCCAGGGTACCCTCGTGACCGT

CTCCTCA

PD-1 Af Hv Variable Heavy Chain Region Amino Acid Sequence:

(SEQ ID NO: 27)
EVQLVESGGGLVQPGGSLRLSCAAS<u>GFTFSGYAMS</u>WVRQAPGKGLEWVA<u>Y</u>

<u>ISNSGGNTH</u>YADSLKGRFTVSRDNSKNTLYLQMNSLRAEDTAVYYCAR<u>ED</u>

<u>YGTSPFVY</u>WGQGTLVTVSS

PD-1 Af Hv Variable Heavy Chain Region Nucleic Acid Sequence:

(SEQ ID NO: 28)
GAAGTGCAGCTGGTGGAATCTGGCGGCGGACTGGTGCAGCCTGGCGGATC

TCTGAGACTGAGCTGTGCCGCCAGCGGCTTCACCTTTAGCGGCTACGCCA

TGAGCTGGGTGCGCCAGGCTCCTGGCAAAGGCCTGGAATGGGTGGCCTAC

ATCAGCAACAGCGGCGGCAATACCCACTACGCCGATAGCCTGAAGGGCCG

GTTCACCGTCAGCCGGGACAACAGCAAGAACACCCTGTACCTGCAGATGA

ACAGCCTGCGGGCCGAGGACACCGCCGTGTACTACTGCGCCAGAGAGGAC

TACGGCACCAGCCCCTTCGTGTATTGGGGCCAGGGTACCCTCGTGACCGT

CTCCTCA

PD-1 Ba Hv Variable Heavy Chain Region Amino Acid Sequence:

(SEQ ID NO: 29)
QVQLVQSGAEVKKPGASVKMSCKAS<u>GYTFTDYYMD</u>WVRQAPGQGLEWIG<u>Y</u>

<u>IYPKNGGSS</u>YAQKFQGRATLTVDTSTSTAYMELSSLRSEDTAVYYCAR<u>KV</u>

<u>VATDY</u>WGQGTLLTVSS

PD-1 Ba Hv Variable Heavy Chain Region Nucleic Acid Sequence:

(SEQ ID NO: 30)
CAGGTGCAGCTGGTGCAGTCTGGCGCCGAAGTGAAGAAACCAGGCGCCAG

CGTGAAGATGAGCTGCAAGGCCAGCGGCTACACCTTCACCGACTACTACA

TGGACTGGGTGCGCCAGGCCCCTGGACAGGGACTGGAATGGATCGGCTAC

ATCTACCCCAAGAACGGCGGCAGCAGCTACGCCCAGAAGTTCCAGGGCAG

AGCCACCCTGACCGTGGACACCAGCACAAGCACCGCCTACATGGAACTGA

GCAGCCTGCGGAGCGAGGACACCGCCGTGTACTACTGCGCCAGAAAGGTG

GTGGCCACAGACTACTGGGGCCAGGGTACCCTGCTGACCGTGTCTAGT

PD-1 Bb Hv Variable Heavy Chain Region Amino Acid Sequence:

(SEQ ID NO: 31)
QVQLVQSGAEVKKPGASVKMSCKAS<u>GYTFTDYYMD</u>WVRQAPGQGLEWIG<u>Y</u>

<u>IYPKNGGSS</u>YAQKFQGRATLTVDKSTSTAYMELSSLRSEDTAVYYCAR<u>KV</u>

<u>VATDY</u>WGQGTLLTVSS

PD-1 Bb Hv Variable Heavy Chain Region Nucleic Acid Sequence:

(SEQ ID NO: 32)
CAGGTGCAGCTGGTGCAGTCTGGCGCCGAAGTGAAGAAACCAGGCGCCAG

CGTGAAGATGAGCTGCAAGGCCAGCGGCTACACCTTCACCGACTACTACA

TGGACTGGGTGCGCCAGGCCCCTGGACAGGGACTGGAATGGATCGGCTAC

ATCTACCCCAAGAACGGCGGCAGCAGCTACGCCCAGAAGTTCCAGGGCAG

AGCCACCCTGACCGTGGACAAGAGCACCAGCACCGCCTACATGGAACTGA

GCAGCCTGCGGAGCGAGGACACCGCCGTGTACTACTGCGCCAGAAAGGTG

GTGGCCACAGACTACTGGGGCCAGGGTACCCTGCTGACCGTGTCTAGT

PD-1 C Hv Variable Heavy Chain Region Amino Acid Sequence:

(SEQ ID NO: 33)
EVQLVESGGGLVQPGGSLRLSCAASGFTFSNYAMSWVRQAPGKGLEWVAY

ISNGGGDTHYADSLKGRFTVSRDNSKNTLYLQMNSLRAEDTAVYYCAREN

YGTSPFVWGQGTLVTVSS

PD-1 C Hv Variable Heavy Chain Region Nucleic Acid Sequence:

(SEQ ID NO: 34)
GAAGTGCAGCTGGTGGAATCTGGCGGCGGACTGGTGCAGCCTGGCGGATC

TCTGAGACTGAGCTGTGCCGCCAGCGGCTTCACCTTCAGCAACTACGCCA

TGAGCTGGGTGCGCCAGGCCCCTGGAAAAGGCCTGGAATGGGTGGCCTAC

ATCAGCAACGGCGGAGGCGATACCCACTACGCCGATAGCCTGAAGGGCCG

GTTCACCGTGTCCAGAGACAACAGCAAGAACACCCTGTACCTGCAGATGA

ACAGCCTGCGGGCCGAGGACACCGCCGTGTACTATTGCGCCAGAGAGAAC

TACGGCACCAGCCCCTTCGTGTACTGGGGCCAGGGTACCCTCGTGACCGT

GTCCTCT

PD-1 Ca Hv Variable Heavy Chain Region Amino Acid Sequence:

(SEQ ID NO: 35)
EVQLVESGGGLVQPGGSLRLSCAASGFTFSNYAMSWVRQAPGKGLEWVAY

ISNQGGDTHYADSLKGRFTVSRDNSKNTLYLQMNSLRAEDTAVYYCAREN

YGTSPFVYWGQGTLVTVSS

PD-1 Ca Hv Variable Heavy Chain Region Nucleic Acid Sequence:

(SEQ ID NO: 36)
GAAGTGCAGCTGGTGGAATCTGGCGGCGGACTGGTGCAGCCTGGCGGATC

TCTGAGACTGAGCTGTGCCGCCAGCGGCTTCACCTTCAGCAACTACGCCA

TGAGCTGGGTGCGCCAGGCCCCTGGAAAAGGCCTGGAATGGGTGGCCTAC

ATCAGCCAAGGCGGAGGCGATACCCACTACGCCGATAGCCTGAAGGGCCG

GTTCACCGTGTCCAGAGACAACAGCAAGAACACCCTGTACCTGCAGATGA

ACAGCCTGCGGGCCGAGGACACCGCCGTGTACTATTGCGCCAGAGAGAAC

TACGGCACCAGCCCCTTCGTGTACTGGGGCCAGGGTACCCTCGTGACCGT

GTCCTCT

PD-1 D Hv Variable Heavy Chain Region Amino Acid Sequence:

(SEQ ID NO: 37)
EVQLVESGGGLVQPGGSLRLSCAHSGFSFSSYDMSWVRQAPGKGLEWVAT

ISGGGRYTYYADSVKGRFTISRDNSKNTLYLQMNSLRAEDTAVYYCASNY

YGFDYWGQGTLLTVSS

PD-1 D Hv Variable Heavy Chain Region Nucleic Acid Sequence:

(SEQ ID NO: 38)
GAAGTGCAGCTGGTGGAATCTGGCGGCGGACTGGTGCAGCCTGGCGGATC

TCTGAGACTGAGCTGTGCCCACAGCGGCTTCAGCTTCAGCAGCTACGACA

TGAGCTGGGTGCGCCAGGCCCCTGGCAAAGGACTGGAATGGGTGGCCACA

ATCAGCGGCGGAGGCCGGTACACCTACTACGCCGATAGCGTGAAGGGCCG

GTTCACCATCAGCCGGGACAACAGCAAGAACACCCTGTACCTGCAGATGA

ACAGCCTGCGGGCCGAGGACACCGCCGTGTACTACTGCGCCAGCAACTAC

TACGGCTTCGACTACTGGGGCCAGGGTACCCTGCTGACCGTGTCATCT

PD-1 1.0 Lv Variable Light Chain Region Amino Acid Sequence:

(SEQ ID NO: 39)
DIQLTQSPSSLSASVGDRVTITCRASESVDNYGISFMNWFQQKPGKAPKL

LIYAASNQGSGVPSRFSGSGSGTDFTLTISSMQPEDFATYYCQQSKDVPW

TFGQGTKLEIK

PD-1 1.0 Lv Variable Light Chain Region Nucleic Acid Sequence:

(SEQ ID NO: 40)
GACATCCAGCTGACCCAGAGCCCTAGCAGCCTGTCTGCCAGCGTGGGCGA

CAGAGTGACCATCACCTGTAGAGCCAGCGAGAGCGTGGACAACTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.1 Lv Variable Light Chain Region Amino Acid Sequence:

(SEQ ID NO: 41)
DIQLTQSPSSLSVSVGDRATITCRASESVDNYGISFMNWFQQKPGKAPKL

LIYAASNQGSGVPSRFSGSGSGTDFTLTISSMQPEDFATYYCQQSKDVPW

TFGQGTKLEIK

PD-1 1.1 Lv Variable Light Chain Region Nucleic Acid Sequence:

(SEQ ID NO: 42)
GACATCCAGCTGACCCAGAGCCCTAGCAGCCTGTCCGTGTCCGTGGGCGA

CAGAGCCACCATCACCTGTAGAGCCAGCGAGAGCGTGGACAACTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.2 Lv Variable Light Chain Region Amino Acid Sequence:

(SEQ ID NO: 43)
DIQLTQSPSSLSASVGDRVTITCRASESVDQYGISFMNWFQQKPGKAPKL

LIYAASNQGSGVPSRFSGSGSGTDFTLTISSMQPEDFATYYCQQSKDVPW

TFGQGTKLEIK

PD-1 1.2 Lv Variable Light Chain Region Nucleic Acid Sequence:

(SEQ ID NO: 44)
GACATCCAGCTGACCCAGAGCCCTAGCAGCCTGTCTGCCAGCGTGGGCGA

CAGAGTGACCATCACCTGTAGAGCCAGCGAGAGCGTGGACCAATACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.4 Lv Variable Light Chain Region Amino Acid Sequence:

(SEQ ID NO: 45)
DIQLTQSPSSLSASVGDRVTITCRASESVDSYGISFMNWFQQKPGKAPKL

LIYAASNQGSGVPSRFSGSGSGTDFTLTISSMQPEDFATYYCQQSKDVPW

TFGQGTKLEIK

PD-1 1.4 Lv Variable Light Chain Region Nucleic Acid Sequence:

(SEQ ID NO: 46)
GACATCCAGCTGACCCAGAGCCCTAGCAGCCTGTCTGCCAGCGTGGGCGA

CAGAGTGACCATCACCTGTAGAGCCAGCGAGAGCGTGGACAGTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.5 Lv Variable Light Chain Region Amino Acid Sequence:

(SEQ ID NO: 47)
DIQLTQSPSSLSASVGDRVTITCRASESVDAYGISFMNWFQQKPGKAPKL

LIYAASNQGSGVPSRFSGSGSGTDFTLTISSMQPEDFATYYCQQSKDVPW

TFGQGTKLEIK

PD-1 1.5 Lv Variable Light Chain Region Nucleic Acid Sequence:

(SEQ ID NO: 48)
GACATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.6 Lv Variable Light Chain Region Amino Acid Sequence:

(SEQ ID NO: 49)
DIQLTQSPSSLSASVGDRVTITCRASESVDNYGISFMNWFQQKPGKAPKL

LIYAASDQGSGVPSRFSGSGSGTDFTLTISSMQPEDFATYYCQQSKDVPW

TFGQGTKLEIK

PD-1 1.6 Lv Variable Light Chain Region Nucleic Acid Sequence:

(SEQ ID NO: 50)
GACATCCAGCTGACCCAGAGCCCTAGCAGCCTGTCTGCCAGCGTGGGCGA

CAGAGTGACCATCACCTGTAGAGCCAGCGAGAGCGTGGACAACTACGGCA

TCAGCTTCATGAACTGGTTCCAGCAGAAGCCCGGCAAGGCCCCCAAGCTG

CTGATCTACGCCGCCAGCGATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.7 Lv Variable Light Chain Region Amino Acid Sequence:

(SEQ ID NO: 51)
DIQLTQSPSSLSVSVGDRATITCRASESVDAYGISFMNWFQQKPGKAPKL

LIYAASNQGSGVPSRFSGSGSGTDFTLTISSMQPEDFATYYCQQSKDVPW

TFGQGTKLEIK

PD-1 1.7 Lv Variable Light Chain Region Nucleic Acid Sequence:

(SEQ ID NO: 52)
GACATCCAGCTGACCCAGAGCCCTAGCAGCCTGTCCGTGTCCGTGGGCGA

CAGAGCCACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG

PD-1 1.9 Lv Variable Light Chain Region Amino Acid Sequence:

(SEQ ID NO: 53)
DIQLTQSPSSLSASVGDRVTITC<u>RASESVDAYGISFMN</u>WFQQKPGKAPKL

LIY<u>AASNQGS</u>GVPSRFSGSGSGTDFTLTISSMQPEDFATYYC<u>QQSKDVPW</u>

<u>T</u>FGQGTKVEIK

PD-1 1.9 Lv Variable Light Chain Region Nucleic Acid Sequence:

(SEQ ID NO: 54)
GACATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGGTGGAAATCAAG

PD-1 1.10 Lv Variable Light Chain Region Amino Acid Sequence:

(SEQ ID NO: 55)
DIQLTQSPSSLSASVGDRVTITC<u>RASESVDAYGISFMN</u>WFQQKPGKAPKL

LIY<u>AASNQGS</u>GVPSRFSGSGSGTDFTLTISSMQPEDFATYYC<u>QQSKDVPY</u>

<u>T</u>FGQGTKLEIK

PD-1 1.10 Lv Variable Light Chain Region Nucleic Acid Sequence:

(SEQ ID NO: 56)
GACATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTAC

ACCTTTGGCCAGGGTACCAAGCTGGAAATCAAG

PD-1 2 Lv Variable Light Chain Region Amino Acid Sequence:

(SEQ ID NO: 57)
DIQMTQSPSSLSASVGDRVTMTC<u>KSSQSLLYSSNQKNYLA</u>WYQQKPGKAP

KLLIF<u>WASIRES</u>GVPSRFSGSGSGTDFTLTISSVQPEDFATYYC<u>QQSDSY</u>

<u>PWT</u>FGQGTKLEIK

PD-1 2 Lv Variable Light Chain Region Nucleic Acid Sequence:

(SEQ ID NO: 58)
GACATCCAGATGACCCAGAGCCCCAGCAGCCTGTCTGCCAGCGTGGGCGA

TAGAGTGACCATGACCTGCAAGAGCAGCCAGAGCCTGCTGTACTCCAGCA

ACCAGAAGAACTACCTGGCCTGGTATCAGCAGAAGCCCGGCAAGGCCCCC

AAGCTGCTGATCTTCTGGGCCAGCATCCGGGAAAGCGGCGTGCCCAGCAG

ATTTTCTGGCTCTGGCAGCGGCACCGACTTCACCCTGACAATCAGCAGCG

TGCAGCCCGAGGACTTCGCCACCTACTACTGCCAGCAGAGCGACAGCTAC

CCCTGGACCTTTGGCCAGGGTACCAAGCTGGAAATCAAG

PD-1 4 Lv Variable Light Chain Region Amino Acid Sequence:

(SEQ ID NO: 59)
DIQMTQSPSSLSASVGDRVTITC<u>KASQDVGTAVA</u>WYQQKPGKAPKLLIYW

ASTRHTGVPSRFSGSGSGTDFTLTISSVQPEDFATYYCQQYSSYPWTFGQ

GTKLEIK

PD-1 4 Lv Variable Light Chain Region Nucleic Acid Sequence:

(SEQ ID NO: 60)
GACATCCAGATGACCCAGAGCCCCAGCAGCCTGTCTGCCAGCGTGGGCGA

CAGAGTGACCATCACATGCAAGGCCAGCCAGGACGTGGGAACAGCCGTGG

CCTGGTATCAGCAGAAGCCTGGCAAGGCCCCCAAGCTGCTGATCTACTGG

GCCAGCACCAGACACACCGGCGTGCCCAGCAGATTTTCTGGCAGCGGCTC

CGGCACCGACTTCACCCTGACAATCAGCAGCGTGCAGCCCGAGGACTTCG

CCACCTACTACTGCCAGCAGTACAGCAGCTACCCCTGGACCTTTGGCCAG

GGTACCAAGCTGGAAATCAAG

Kappa Constant Region Amino Acid Sequence:

(SEQ ID NO: 61)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC

Kappa Constant Region Nucleic Acid Sequence:

(SEQ ID NO: 62)
CGTACGGTGGCTGCACCATCTGTCTTCATCTTCCCGCCATCTGATGAGCA

GTTGAAATCTGGAACTGCCTCTGTTGTGTGCCTGCTGAATAACTTCTATC

-continued
CCAGAGAGGCCAAAGTACAGTGGAAGGTGGATAACGCCCTCCAATCGGGT

AACTCCCAGGAGAGTGTCACAGAGCAGGACAGCAAGGACAGCACCTACAG

CCTCAGCAGCACCCTGACGCTGAGCAAAGCAGACTACGAGAAACACAAAG

TCTACGCCTGCGAAGTCACCCATCAGGGCCTGAGCTCGCCCGTCACAAAG

AGCTTCAACAGGGGAGAGTGT hIgG4 S228P Amino Acid Sequence:

(SEQ ID NO: 63)
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES

KYGPPCPPCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK

GFYPSDIAVEWESNGQPENNYKTTPPVLDSDGSFFLYSRLTVDKSRWQEG

NVFSCSVMHEALHNHYTQKSLSLSLGK hIgG4 S228P Nucleic Acid Sequence:

(SEQ ID NO: 64)
GCTAGCACCAAGGGCCCATCGGTCTTCCCCCTGGCACCCTGTAGCAGAAG

CACCAGCGAGTCTACAGCGGCCCTGGGCTGCCTGGTCAAGGACTACTTCC

CCGAACCGGTGACGGTGTCGTGGAACTCAGGCGCCCTGACCAGCGGCGTG

CACACCTTCCCGGCTGTCCTACAGTCCTCAGGACTCTACTCCCTCAGCAG

CGTGGTGACCGTGCCCTCCAGCAGCTTGGGCACCAAGACCTACACCTGTA

ACGTGGACCACAAGCCCAGCAACACCAAGGTGGACAAGCGGGTGGAATCT

AAGTACGGCCCTCCCTGCCCTCCTTGCCCAGCCCCTGAATTTCTGGGGGG

ACCGTCAGTCTTCCTCTTCCCCCCAAAACCCAAGGACACCCTCATGATCT

CCCGGACCCCTGAGGTCACATGCGTGGTGGTGGACGTGAGCCAGGAAGAC

CCTGAGGTCCAGTTCAACTGGTACGTGGACGGCGTGGAGGTGCATAATGC

CAAGACAAAGCCGCGGGAGGAGCAGTTCAACAGCACGTACCGTGTGGTCA

GCGTCCTCACCGTCCTGCACCAGGACTGGCTGAATGGCAAGGAGTACAAG

TGCAAGGTCTCCAACAAAGGCCTGCCCAGCTCCATCGAGAAAACCATCTC

CAAAGCCAAAGGGCAGCCCCGAGAACCACAGGTGTACACCCTGCCCCCAT

CCCAGGAGGAGATGACCAAGAACCAGGTCAGCCTGACCTGCCTGGTCAAA

GGCTTCTATCCCAGCGACATCGCCGTGGAGTGGGAGAGCAATGGGCAGCC

GGAGAACAACTACAAGACCACGCCTCCCGTGCTGGACTCCGACGGCTCCT

TCTTCCTCTACAGCAGACTCACCGTGGACAAGAGCAGGTGGCAGGAAGGG

AACGTCTTCTCATGCTCCGTGATGCATGAGGCTCTGCACAACCACTACAC

GCAGAAGAGCCTCTCCCTGTCTCTGGGTAAA

These variable heavy chain regions (VH) and variable light chain regions (VL) can be used in a variety of combinations to produce anti-PD-1 antibodies of the disclosure. For example, the antibody referred to herein as A1.0 includes the VH sequence of SEQ ID NO: 21 and the VL sequence of SEQ ID NO: 39, the A1.5 antibody includes the VH sequence of SEQ ID NO: 21 and the VL sequence of SEQ ID NO: 47; the antibody referred to herein as C1.1 includes the VH sequence of SEQ ID NO: 33 and the VL sequence of SEQ ID NO: 41, and so on.

Figure 4:
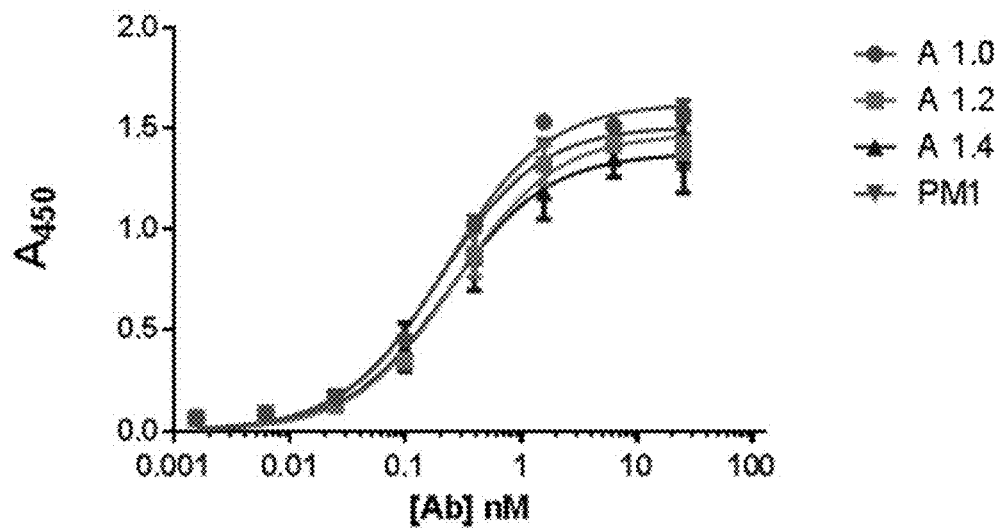
FIG. 4 is a graph depicting binding to human PD-1 of various anti-hPD-1 antibodies of the disclosure referred to herein as A1.0 (VH: SEQ ID NO: 21; VL: SEQ ID NO: 39), A1.2 (VH: SEQ ID NO: 21; VL: SEQ ID NO: 43), and A1.4 (VH: SEQ ID NO: 21; VL: SEQ ID NO: 45) as determined by ELISA. The anti-PD-1 antibody pembrolizumab ("PM1") was used as positive control.
Figure 5:
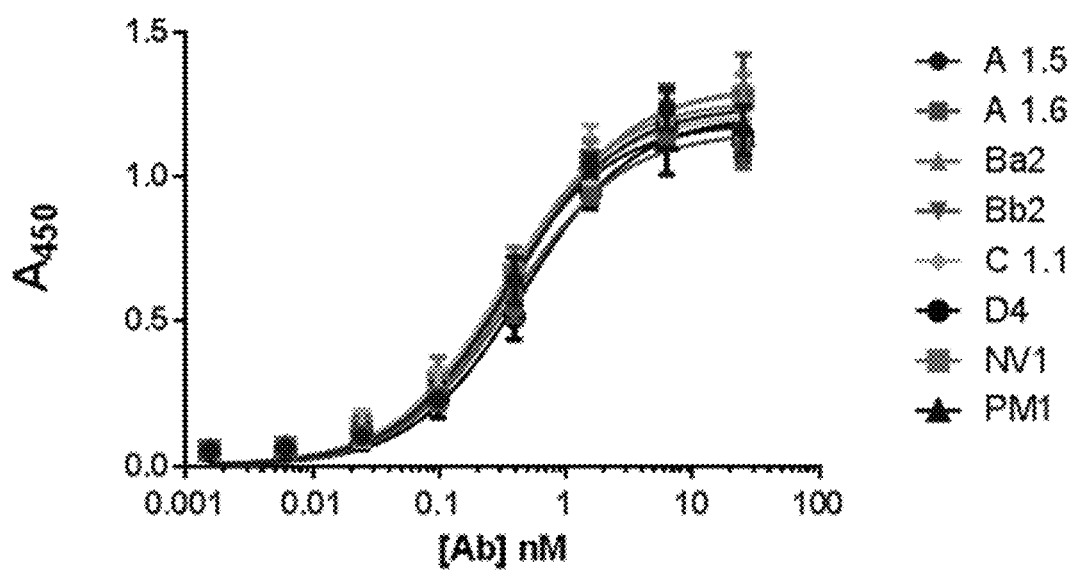
FIG. 5 is a graph depicting binding to human PD-1 of various anti-hPD-1 antibodies of the disclosure referred to herein as A1.5 (VH: SEQ ID NO: 21; VL: SEQ ID NO: 47), A1.6 (VH: SEQ ID NO: 21; VL: SEQ ID NO: 49), Ba2 (VH: SEQ ID NO: 29; VL: SEQ ID NO: 57), Bb2 (VH: SEQ ID NO: 31; VL: SEQ ID NO: 57), C1.1 (VH: SEQ ID NO: 33; VL: SEQ ID NO: 41), and D4 (VH: SEQ ID NO: 37; VL: SEQ ID NO: 59) as determined by ELISA. The anti-PD-1 antibodies nivolumab ("NV1") and pembrolizumab ("PM1") were used as positive controls.
Figure 6:
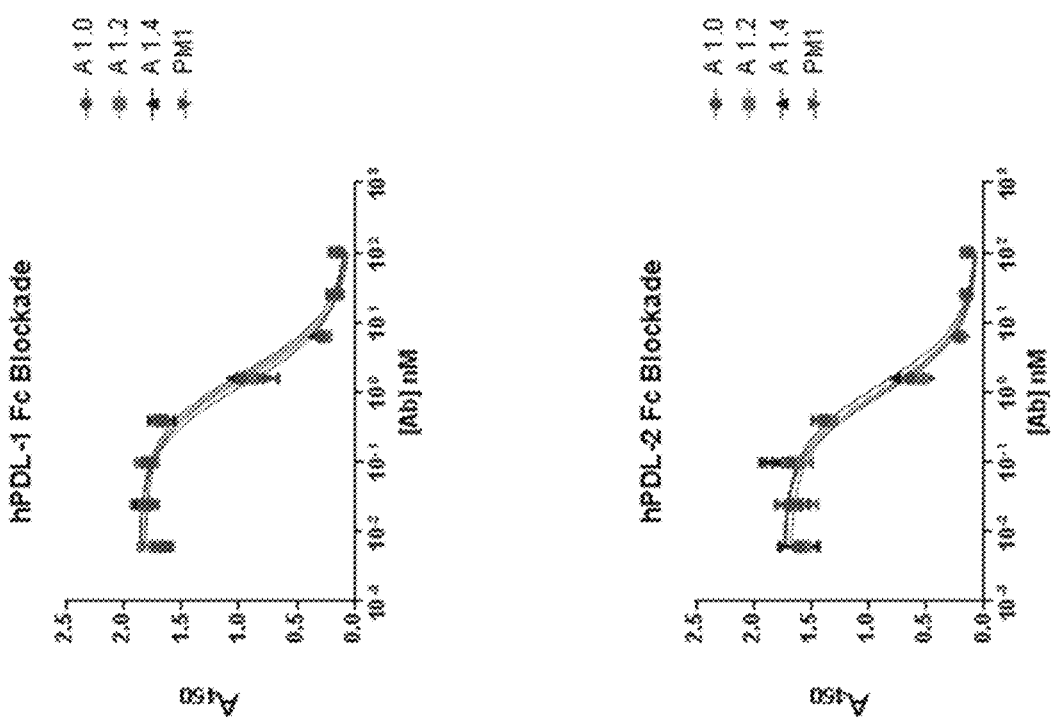
FIG. 6 is a series of graphs depicting the ability of various anti-hPD-1 antibodies of the disclosure referred to herein as A1.0, A1.2, and A1.4 to inhibit binding between human PD-1 (hPD-1) and both human PDL-1 (hPDL-1) and human PDL-2 (hPDL-2) as determined by ELISA. The anti-PD-1 antibody pembrolizumab ("PM1") was used as positive control.
Figure 7:
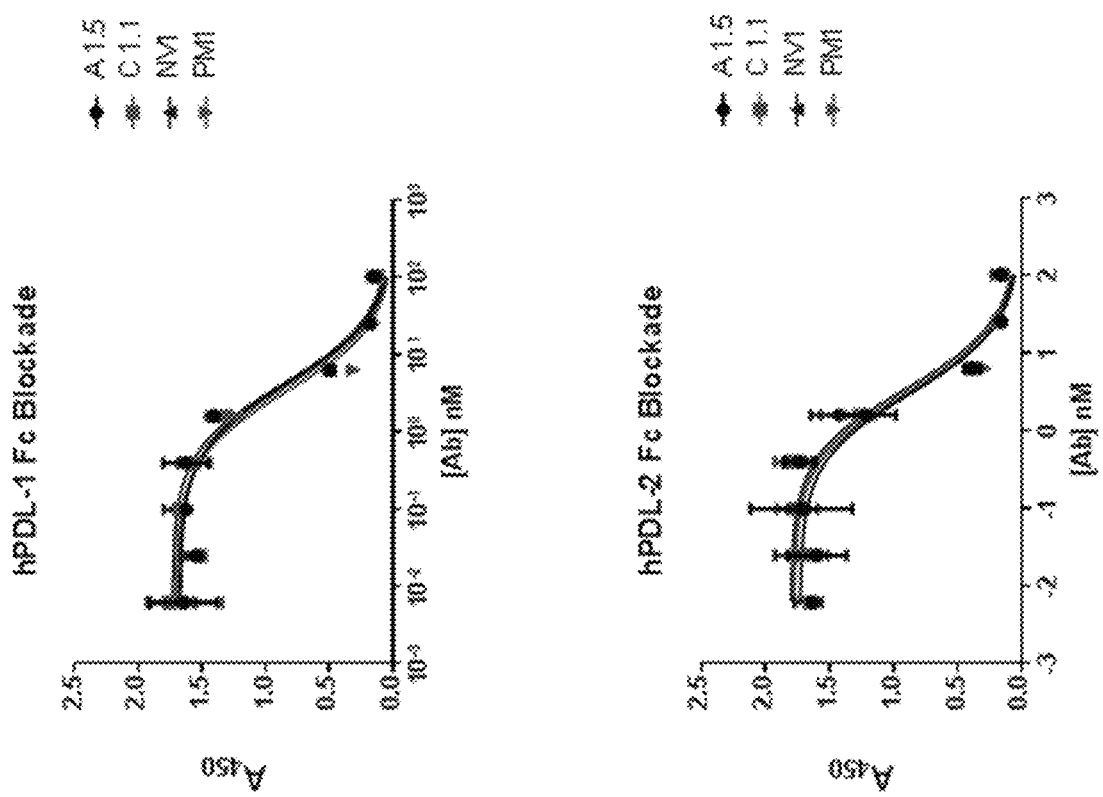
FIG. 7 is a series of graphs depicting the ability of various anti-hPD-1 antibodies of the disclosure referred to herein as A1.5 and C1.1 to inhibit binding between hPD-1 and both hPDL-1 and hPDL-2 as determined by ELISA. The anti-PD-1 antibodies nivolumab ("NV1") and pembrolizumab ("PM1") were used as positive controls.
Figure 8:
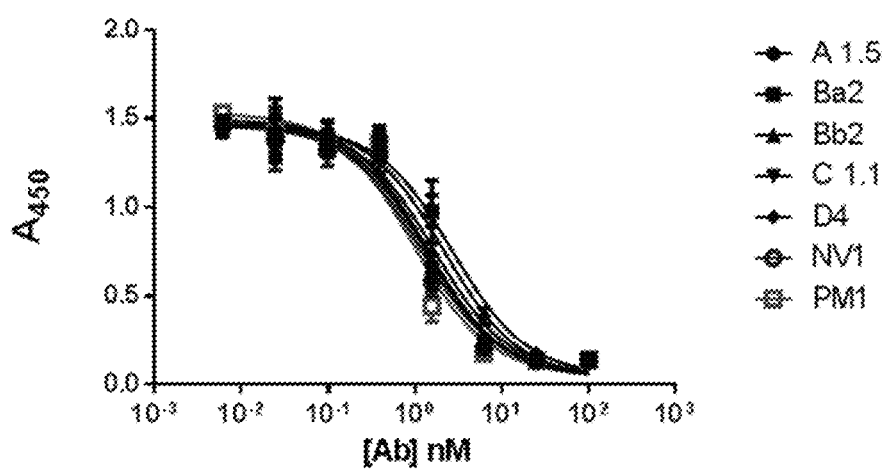
FIG. 8 is a graph depicting the ability of various anti-hPD-1 antibodies of the disclosure referred to herein as A1.5, Ba2, Bb2, C1.1, and D4 to inhibit binding between hPD-1 and hPDL-1 as determined by ELISA. The anti-PD-1 antibodies nivolumab ("NV1") and pembrolizumab ("PM1") were used as positive controls.
Figure 9:
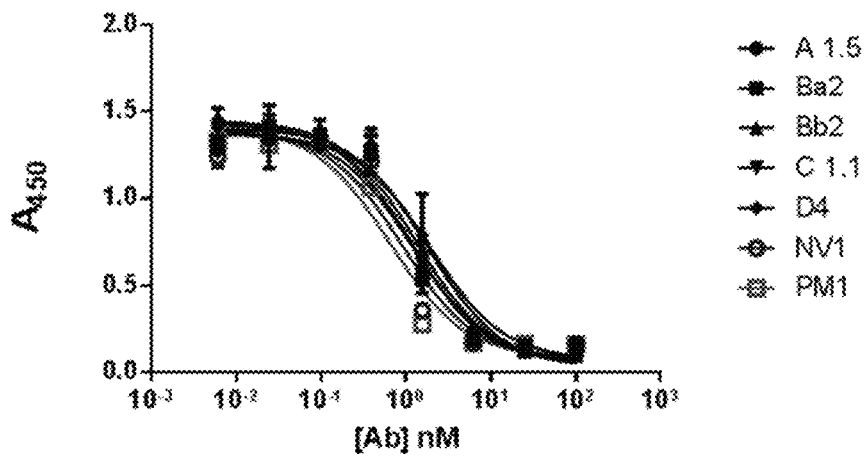
FIG. 9 is a graph depicting the ability of various anti-hPD-1 antibodies of the disclosure referred to herein as A1.5, Ba2, Bb2, C1.1, and D4 to inhibit binding between hPD-1 and hPDL-2 as determined by ELISA. The anti-PD-1 antibodies nivolumab ("NV1") and pembrolizumab ("PM1") were used as positive controls.

As shown in FIGS. 4-5, humanized anti-PD-1 antibodies bound to hPD-1 in a standard ELISA in a manner similar to that of nivolumab and/or pembrolizumab, and binding of the humanized antibodies inhibited the binding of PD-1 to PDL1 and PDL2 (FIGS. 6-9) in inhibition ELISAs. ELISAs were performed as follows. For hPD-1 binding ELISAs, human PD-1-Fc (R and D systems, Minneapolis, Minn.) was adsorbed to the wells of a 96-well ELISA plate. Purified anti-PD-1 antibodies were applied to the plate in serial dilution and allowed to bind. Bound antibody was detected with an anti-human IgG-HRP conjugate (FAb-specific) (Sigma, St Louis, Mo.) and visualized with the chromogenic substrate TMB (Thermo Scientific, Rockford, Ill.). Plots were generated in Prizm (Sigma Plot) and the data were fit to a model of single site saturation binding. For ligand inhibition ELISAs, human PD-1-Fc (R and D systems, Minneapolis, Minn.) was adsorbed to the wells of a 96-well ELISA plate. Purified anti-PD-1 antibodies were applied to the plate in serial dilution in the presence of 2 nM biotinylated hPD-L1 or 2 nM biotinylated hPD-L2. Pierce™ Streptavidin-poly HRP conjugate (Thermo Scientific, Rockford, Ill.) and visualized with TMB. Plots were generated in Prizm (Sigma Plot) and the data were fit to a model of single site competition binding and an $IC_{50}$ was determined.

Example 3: Anti-PD-1 Antibodies Shows Specificity in Binding

Example 3 shows that humanized anti-PD-1 antibody groups A1 and C1 of the disclosure bind specifically to hPD-1 by plate ELISA.

Figure 10:
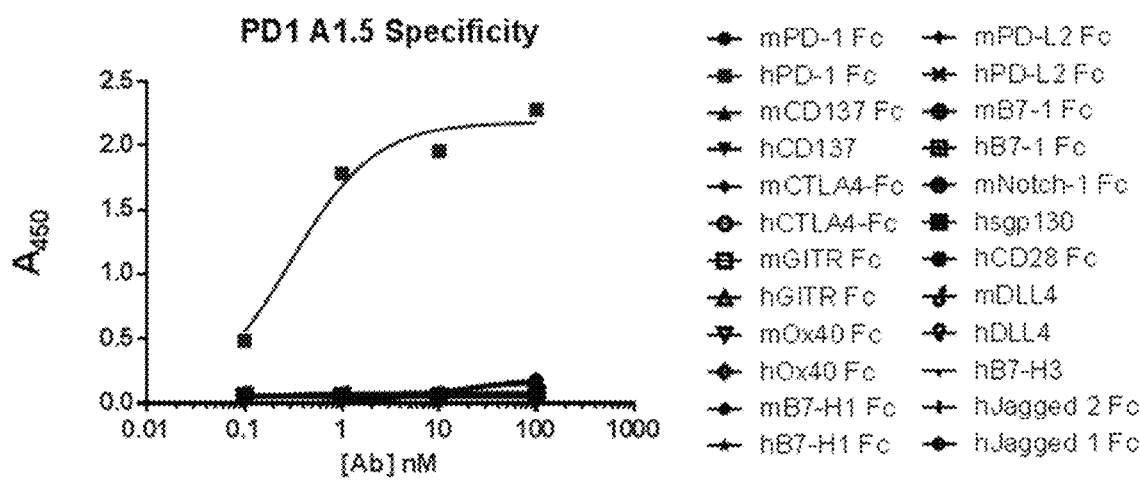
FIG. 10 is a graph depicting that the anti-PD-1 antibody referred to herein as A1.5 specifically binds hPD-1 as determined by ELISA. The A1.5 anti-PD-1 antibody was tested against a panel of human and mouse proteins.

The binding of anti-PD-1 antibody A1.5 of the disclosure was highly specific to hPD-1-Fc in a standard ELISA against a panel of numerous human and mouse proteins (FIG. 10). Binding of anti-PD-1 A1.5 was detected with an anti-human IgG-HRP conjugate (FAb-specific) (Sigma, St Louis, Mo.) and visualized with the chromogenic substrate TMB (Thermo Scientific, Rockford, Ill.). Plots were generated in Prizm (Sigma Plot) and the data were fit to a model of single site saturation binding.

Example 4: Anti-PD-1 Epitope Binding

This example compares the epitopes bound by humanized anti-PD-1 antibodies of the disclosure, nivolumab, and pembrolizumab.

Figure 11A:
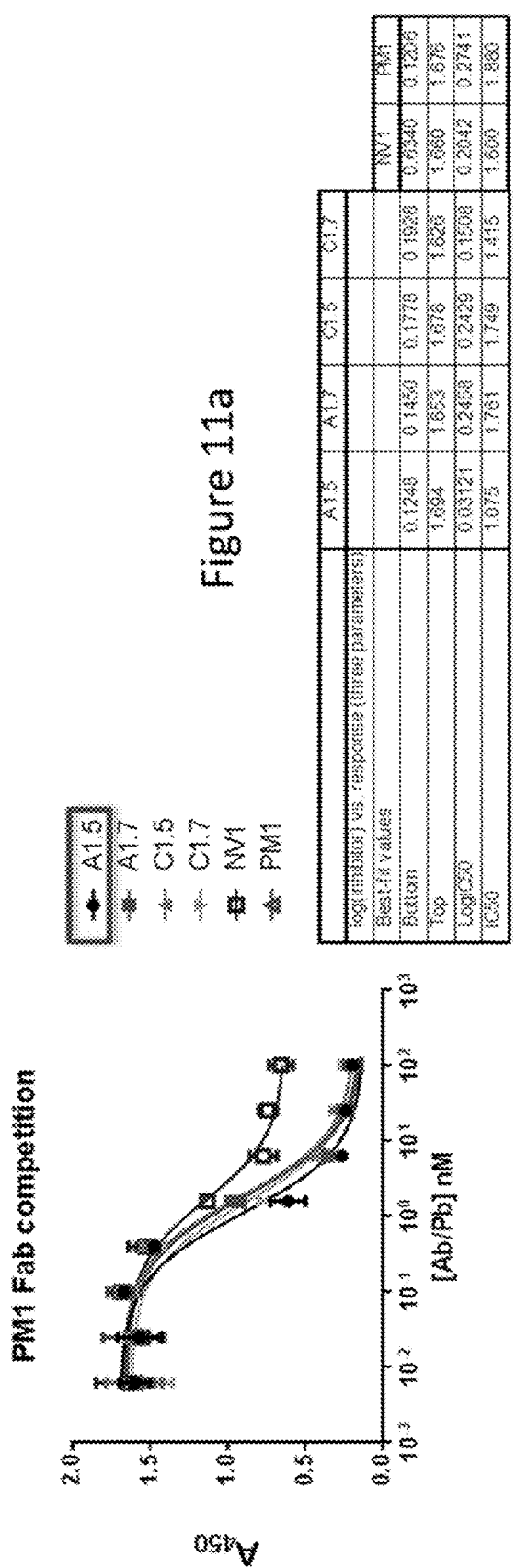

Nivolumab and pembrolizumab anti-PD-1 antibodies each bind human PD-1 and such binding by each inhibits the binding of PD-1 to PDL1 and PDL2. To map the epitopes of humanized groups A1 and C1 antibodies of the disclosure, anti-PD-1 inhibition ELISAs were performed, and compared with nivolumab and pembrolizumab inhibition. Dilution series of nivolumab, pembrolizumab, A1 and C1 antibodies were incubated in the presence of biotinylated nivolumab FAb or biotinylated pembrolizumab FAb at a concentration of 0.3 nM in a standard plate ELISA format with hPD-1-Fc (R & D systems, Minneapolis, Minn.). Binding of biotinylated FAb was detected by Pierce™ Streptavidin-poly HRP conjugate (Thermo Scientific, Rockford, Ill.) and visualized with TMB (Thermo Scientific, Rockford Ill.) and 1N HCl. Antibodies belonging to the A1 and C1 groups of the disclosure blocked biotinylated Pembrolizumab FAb binding to PD-1 similarly to Pembrolizumab antibody and more completely than nivolumab antibody (FIG. 11A). The same A1 and C1 antibodies of the disclosure blocked biotinylated nivolumab binding similarly to nivolumab antibody and more completely than pembrolizumab antibody (FIG. 11B). The data in FIGS. 11A and 11B show that A1 and C1 antibodies of the disclosure completely block both nivolumab and pembrolizumab, whereas nivolumab and pembrolizumab incompletely block each other.

Example 5: Anti-PD-1 A1.5 Enhances CMV-Stimulated Cytokine Secretion by PBMCs from a CMV-Positive Donor In this example, peripheral blood mononuclear cells from a CMV-positive donor were incubated in the presence of CMV viral lysate and anti-PD-1 antibodies of the disclosure to assess the effect of such anti-PD-1 antibodies on interferon gamma (IFN-gamma, IFNg, IFN-g, IFNγ, or IFN-γ) cytokine secretion.

Figure 12:
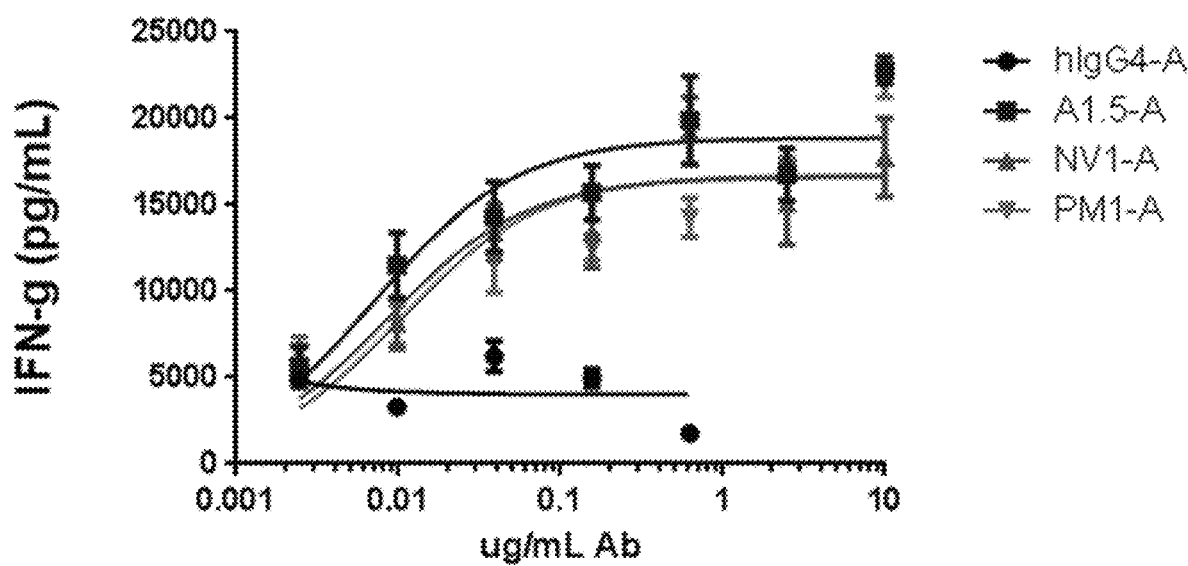
FIG. 12 is a graph demonstrating that the anti-PD-1 antibody A1.5 has a potency similar to that of nivolumab ("NV1") and pembrolizumab ("PM1") measured in a T-cell restimulation assay.

PBMCs from a CMV-positive donor (Hemacare) were plated at $2 \times 10^5$ cells/well in the presence of CMV viral lysate (Astarte) and either anti-PD-1 antibody A1.5 of the disclosure or a hIgG4 isotype control antibody. After four days, supernatant was removed from each well, and IFN-gamma levels were assayed using IFN-gamma ELISA kit (Life Technologies, Carlsbad, Calif.) (FIG. 12). Anti-PD-1 antibody A1.5 increased CMV-stimulated IFN-gamma secretion compared with control hIgG4 and with potency similar to anti-PD-1 nivolumab and pembrolizumab antibodies.

Example 6: Anti-PD-1 Antibodies Bind to Monomeric hPD-1 with High Affinity and Slow Dissociation Kinetics In this example, humanized anti-PD-1 antibodies of the disclosure are shown to bind with high affinity and slow dissociation to monomeric PD-1.

Figure 13:
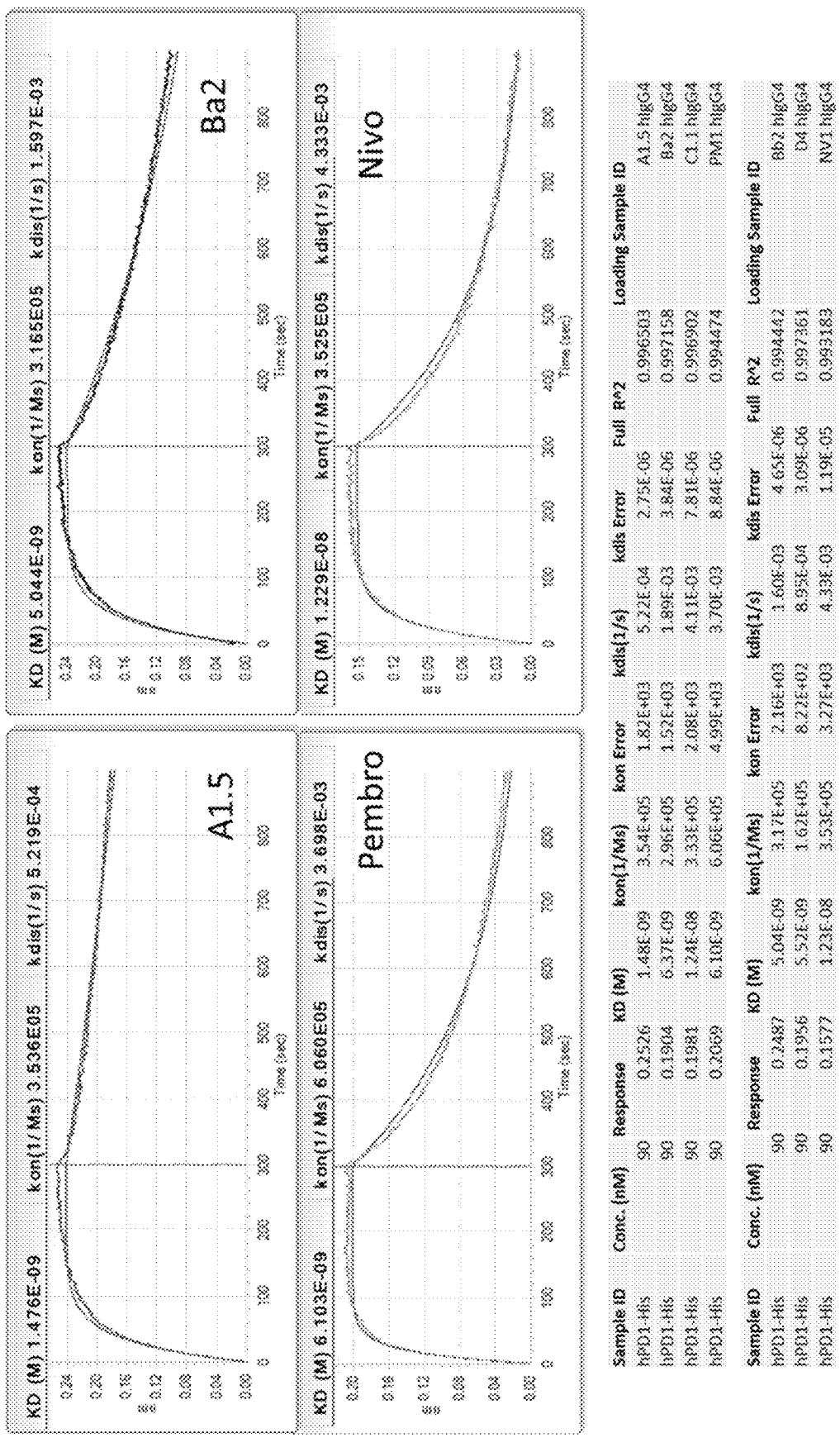
FIG. 13 is a series of graphs demonstrating that the anti-PD-1 antibodies A1.5 and Ba2 bind monomeric human PD-1 (hPD1) with similar or higher affinity than the anti-PD-1 antibodies nivolumab ("Nivo") and pembrolizumab ("Pembro").

Activatable antibodies can be activated singly, creating a monovalent binding moiety, or doubly, creating a bivalent binding moiety. Single-arm activation of antibodies with differing avidities can favor binding and biological activity of activatable antibodies with higher monovalent affinities. Anti-PD-1 antibodies A1.5 and Bba2 of the disclosure, as well as nivolumab and pembrolizumab were immobilized at equivalent densities on Forte-Bio Octet BioLayer Inferometry (Pall ForteBio, Menlo Park, Calif.) sensors and allowed to bind to a serial dilution of human PD-1-His (R & D systems, Minneapolis, Minn.) in solution. Kinetic analysis was performed with ForteBio Data Analysis software. Results (FIG. 13) show PD-1 antibodies of the disclosure bind monomeric PD-1 with similar or higher affinities and similar or slower dissociation constants than nivolumab or pembrolizumab.

Example 7: Activatable Anti-PD-1 M13/A1.4/A1.5 Antibody Masking Moieties

This example describes identification of masking moieties (MM) that reduce binding of anti-PD-1 antibodies of the disclosure to their target.

Anti-PD-1 antibodies m136-M13, A1.4 and A1.5 were used to screen libraries using a method similar to that described in PCT International Publication Number WO 2010/081173, published 15 Jul. 2010. The screening consisted of one round of MACS and five rounds of FACS sorting. For the initial MACS, approximately $2 \times 10^{11}$ cells were incubated with m136-M13 antibody at a concentration of 100 nM, and $6 \times 10^6$ binders were collected using Protein-G Dynabeads (Invitrogen). FACS rounds were conducted labeling cells with DyLight 650 (Thermo-Fisher) labeled m136-M19 antibody for FACS rounds 1-4 as follows: 100 nM FACS round 1 (F1), 10 nM FACS round 2 (F2), 2 nM FACS round 3 (F3) and 1 nM FACS round 4 (F4), with increasingly small percentages of binders as assessed by fluorescence collected at each round. For FACS round 5 (F5), cells were labeled with 1 nM DyLight 650 labeled A1.5 antibody and the brightest 0.2-4% of cells were collected. Individual peptide clones from F3, F4 and F5 were identified by sequence analysis and subsequently verified for their ability to bind DyLight-650 A1.4 or DyLight-650 A1.5.

The sequences of the anti-PD-1 m136-M13, A1.4 and A1.5 masking moieties are listed in Table 12 (masking moiety PD001 is also referred to in the disclosure as PD01 and/or PD-01; masking moiety PD002 is also referred to herein as PD02 and/or PD-02, and so on):

TABLE 12

Masking Moieties

| Mask | Amino Acid Sequence | SEQ ID NO: |
|---|---|---|
| PD001 | AMSGCSWSAFCPYLA | 66 |
| PD002 | DVNCAIWYSVCTTVP | 67 |
| PD003 | LVCPLYALSSGVCMG | 68 |
| PD004 | SVNCRIWSAVCAGYE | 69 |
| PD005 | MLVCSLQPTAMCERV | 70 |
| PD006 | APRCYMFASYCKSQY | 71 |
| PD007 | VGPCELTPKPVCNTY | 72 |
| PD008 | ETCNQYERSSGLCFA | 73 |
| PD009 | APRTCYTYQCSSFYT | 74 |
| PD010 | GLCSWYLSSSGLCVD | 75 |
| PD011 | VPWCQLTPRVMCMWA | 76 |
| PD012 | NWLDCQFYSECSVYG | 77 |
| PD013 | SCPLYVMSSFGGCWD | 78 |
| PD014 | MSHCWMFSSSCDGVK | 79 |
| PD015 | VSYCTWLIEVTCLRG | 80 |
| PD016 | VLCAAYALSSGICGG | 81 |
| PD017 | TTCNLYQQSSMFCNA | 82 |
| PD018 | APRCYMFASYCKSQY | 83 |
| PD019 | PCDQNPYFYPYVCHA | 84 |
| PD020 | SVCPMYALSSMLCGA | 85 |
| PD021 | LSVECYVFSRCSSLP | 86 |
| PD022 | FYCTYLVSLTCHPQ | 87 |
| PD023 | SMAGCQWSSFCVQRD | 88 |
| PD024 | IYSCYMFASRCTSDK | 89 |
| PD025 | SRCSVYEVSSGLCDW | 90 |
| PD026 | GMCSAYAYSSKLCTI | 91 |
| PD027 | MTTNTCNLLCQQFLT | 92 |

TABLE 12-continued

Masking Moieties

| Mask | Amino Acid Sequence | SEQ ID NO: |
|---|---|---|
| PD028 | FQPCLMFASSCFTSK | 93 |
| PD029 | WNCHPAGVGPVFCEV | 94 |
| PD030 | ALCSMYLASSGLCNK | 95 |
| PD031 | NYLSCQFFQNCYETY | 96 |
| PD032 | GWCLFSDMWLGLCSA | 97 |
| PD033 | EFCARDWLPYQCSSF | 98 |
| PD034 | TSYCSIEHYPCNTHH | 99 |
| PD035 | PYICSSFPLDCQAGQ | 100 |
| PD036 | VGCEWYMSSSGMCSR | 101 |
| PD037 | EVCGGCSMQSVSCWP | 102 |
| PD038 | FTECQLSPKAICMSN | 103 |
| PD039 | KYCLFSEYVEGTCLN | 104 |
| PD040 | SGCPMYAWGWDECWR | 105 |
| PD041 | VDCPWYASSSAICSR | 106 |
| PD042 | DMLLCQIRGSCAAWG | 107 |
| PD043 | ECHPYQASASLWCGY | 108 |
| PD044 | MMMGCMWSAWCPPSR | 109 |
| PD045 | NAYFRCSLMCNMFMF | 110 |
| PD046 | ACCKESVHSVHDCKR | 111 |
| PD047 | ACIGINSYMSNYCYL | 112 |
| PD048 | ANCSFLELTNKFCTI | 113 |
| PD049 | AYCSYLMFASNPCII | 114 |
| PD050 | CFTSKCPCLCYSLLA | 115 |
| PD051 | CLCRDINCWLGCSKT | 116 |
| PD052 | CWCDIYCSPYQCSSF | 117 |
| PD053 | DCIYYYQQSANLCSY | 118 |
| PD054 | DCTGVNYYIDKHCTN | 119 |
| PD055 | DECHGYLRSSGLCGG | 120 |
| PD056 | DICSAYAASSGFCYY | 121 |
| PD057 | DIICVLTPTAWCGRT | 122 |
| PD058 | DNCCMYCSWWIACRD | 123 |
| PD059 | DSCQWYMLSADLCGT | 124 |
| PD060 | DSVCFSSSSFLCHKS | 125 |
| PD061 | DTMCAIWWTVCSGGR | 126 |
| PD062 | ECTYQTSSFHEACMS | 127 |
| PD063 | EGCNLYERSSYGCNN | 128 |
| PD064 | EGCTAFAMSAGICGG | 129 |
| PD065 | EQSCSLTPIAFCWSE | 130 |
| PD066 | EWCNAYISSSKLCST | 131 |
| PD067 | FEVCYMFASACRNGM | 132 |
| PD068 | FSCSWYAESSSLCDI | 133 |
| PD069 | FVCQMFEASSGLCGG | 134 |
| PD070 | FYCPCCMFASSCGSR | 135 |
| PD071 | FYCSYLPGASHQCSH | 136 |
| PD072 | FYCSYLYMCEVCCYE | 137 |
| PD073 | GFCTQHTVLTWCPTS | 138 |
| PD074 | GSCPSYAVSAGLCYA | 139 |
| PD075 | GSQCFLTPTAFCTHT | 140 |
| PD076 | GTCHPYMQSSKICNN | 141 |
| PD077 | GVECFVFTGGCGGYG | 142 |
| PD078 | HELCNGHWVPCCWAY | 143 |
| PD079 | ICDSYYAVSSGLCLL | 144 |
| PD080 | IGCAWYVSSAGWCSP | 145 |
| PD081 | INLCWMFASECGEHH | 146 |
| PD082 | KCWLAEMTNLEHCNM | 147 |
| PD083 | KHCSDFAYSSRLCDR | 148 |
| PD084 | KVCSSYASSSGLCGW | 149 |
| PD085 | LDSCYMFASYCVQAV | 150 |
| PD086 | LLACHPIFVTVCQTR | 151 |
| PD087 | LLSCPYNPEHVCHTS | 152 |
| PD088 | LMCSLYALSSNLCGR | 153 |
| PD089 | LMWCVLFLWSWCCRI | 154 |
| PD090 | LPICHLTPTAVCTHI | 155 |
| PD091 | LSNMCLAFGSCLYAW | 156 |
| PD092 | LSRCHPIWYTICQNP | 157 |
| PD093 | LTQCMSVHKECGGYE | 158 |
| PD094 | LVNCRIWSWVCEEAT | 159 |
| PD095 | LYCSWYQMSSAVCKE | 160 |
| PD096 | MECGWYALSARFCEV | 161 |
| PD097 | MTCSPYAMSAHFCNE | 162 |
| PD098 | MVCSLYAYSASLCGA | 163 |
| PD099 | NALCWSTFSWWCDMD | 164 |
| PD-100 | NFTCMLTPKAYCVQT | 165 |
| PD-101 | NGACIFTLSWCTNKT | 166 |
| PD-102 | NGCELYAAASGLCRT | 167 |
| PD-103 | NIECSVFGRCCCDNY | 168 |

TABLE 12-continued

Masking Moieties

| Mask | Amino Acid Sequence | SEQ ID NO: |
|---|---|---|
| PD-104 | PACRPMFWNRSCDNI | 169 |
| PD-105 | PCRVSNMFFPYNCLD | 170 |
| PD-106 | PFMCMLLPESYCWIW | 171 |
| PD-107 | PQSCYMFASLCMPNG | 172 |
| PD-108 | PRCPQGLPLYQCSSF | 173 |
| PD-109 | PSVECLVFKRCYALP | 174 |
| PD-110 | PVCQRSATIYNCNWF | 175 |
| PD-111 | QCAAYYISSFGGCSN | 176 |
| PD-112 | QFGCFMLARDFCGTY | 177 |
| PD-113 | QMMCPYNPEHKCHQK | 178 |
| PD-114 | QRECWMFASSCNSKN | 179 |
| PD-115 | QSNMCTTYICSSFNY | 180 |
| PD-116 | QSRCHSLAPYLCSSF | 181 |
| PD-117 | RAYCSLLFADSCNNN | 182 |
| PD-118 | RCIGINQYIDSNCYN | 183 |
| PD-119 | RLSCFMFASQCALEF | 184 |
| PD-120 | RQCIILMNHRQCFFK | 185 |
| PD-121 | RSCTPYMMSSSLCNT | 186 |
| PD-122 | RYCHYWKMPYECSSF | 187 |
| PD-123 | SCVSLSWFDMLKCYE | 188 |
| PD-124 | SDNCEIWWTVCSAAM | 189 |
| PD-125 | SFCWSYLVSSGLCGV | 190 |
| PD-126 | SMCMNNYGTTFMCGN | 191 |
| PD-127 | SMVGCGWSTFCPSRG | 192 |
| PD-128 | SSLHCANGHTCPFCL | 193 |
| PD-129 | SVCSYYEESSGICSP | 194 |
| PD-130 | SWCGWYAASSGVCAL | 195 |
| PD-131 | TCISQTIDSYLNCVN | 196 |
| PD-132 | TFCNLYTKSSNICMS | 197 |
| PD-133 | TYCVFHEYLDNTCNN | 198 |
| PD-134 | VATGCPNLMLCGSWP | 199 |
| PD-135 | VEYCSLLLGNRCDYW | 200 |
| PD-136 | VGCNMYLMSAGLCVD | 201 |
| PD-137 | VLYCSWDSGTCVGSH | 202 |
| PD-138 | VMFSCYYLETCAPGV | 203 |
| PD-139 | VRIGLCPESCLVSGF | 204 |
| PD-140 | VTCTYYATSSSLCNT | 205 |
| PD-141 | VTGCILLPKAWCWGD | 206 |
| PD-142 | VWCSIYEYSSNLCSR | 207 |
| PD-143 | WMLECQYNNTCNNMT | 208 |
| PD-144 | WPCSPLEYYNNICNV | 209 |
| PD-145 | WTYDCHLNQTCPTYY | 210 |
| PD-146 | YCSINMYLIGGNCMY | 211 |
| PD-147 | YFCSLYANSAGFCGG | 212 |
| PD-148 | YVSCYMFSSSCPSTW | 213 |

Example 8: Activatable Anti-PD-1 A1.4 and A1.5 Antibodies

This example describes examples of activatable anti-PD-1 A1.4 and A1.5 antibodies of the disclosure.

Activatable anti-PD-1 A1.4 antibodies comprising an anti-PD-1 M13 masking moiety, a cleavable moiety, and an anti-PD-1 A1.4 antibody of the disclosure and activatable anti-PD-1 A1.5 antibodies comprising an anti-PD-1 M13 or an anti-PD-1 A1.5 masking moiety, a cleavable moiety selected from the group consisting of a cleavable moiety, and an anti-PD-1 A1.5 antibody were produced according to methods similar to those described in PCT Publication Nos. WO 2009/025846 and WO 2010/081173, the contents of which are hereby incorporated by reference in their entirety. In some embodiments, the cleavable moiety was selected from the group consisting of a cleavable moiety referred to herein as "2001" and comprising the sequence ISSGLLS-GRSDNH (SEQ ID NO: 214) and a cleavable moiety referred to herein as "3001" and comprising the sequence AVGLLAPPGGLSGRSDNH (SEQ ID NO: 318). The amino acid and nucleic acid sequences of several activatable anti-PD-1 antibody variable domains of the disclosure are provided below. Antibodies were produced as hIgG4 containing a single amino acid substitution, S228P (Angal, et al. 1993. Mol Immunol 30:105-8.) HC and hK LC format.

In some embodiments, the activatable antibody also includes a spacer sequence. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. In some embodiments, the spacer joined directly to the N-terminus of MM of the activatable antibody is selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. In some embodiments, the spacer includes at least the amino acid sequence QGQSGQG (SEQ ID NO: 362). In some embodiments, the spacer includes at least the amino acid sequence QGQSGQ (SEQ ID NO: 913). In some embodiments, the spacer includes at least the amino acid sequence QGQSG (SEQ ID NO: 914). In some embodiments, the spacer includes at least the amino acid sequence QGQS (SEQ ID NO: 915), In some embodiments, the spacer includes at least the amino acid sequence QGQ (SEQ ID NO: 916). In some embodiments, the spacer includes at least the amino acid sequence QG (SEQ ID NO: 917). In some embodiments, the spacer includes at least the amino acid residue Q. In some embodiments, the activatable antibody does not include a spacer sequence.

While the sequences shown below include the spacer sequence of SEQ ID NO: 362, those of ordinary skill in the art appreciate that the activatable anti-PD-1 antibodies of the disclosure can include any suitable spacer sequence, such as, for example, a spacer sequence selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. Additional examples of spacers include GQSGQG (SEQ ID NO: 2042), QSGQG (SEQ ID NO: 2043), SGQG (SEQ ID NO: 2044), GQG (SEQ ID NO: 2045), QG (SEQ ID NO: 2046), and G. While the sequences shown below include the spacer sequence of SEQ ID NO: 362, those of ordinary skill in the art will also appreciate that activatable anti-PD-1 antibodies of the disclosure in some embodiments do not include a spacer sequence.

Activatable Anti-PD-1 Variable Domains:

[Spacer (SEQ ID NO: 362)] [PD-1 1.4 PD001 2001 (SEQ ID NO: 919)]

(SEQ ID NO: 215)
[QGQSGQG][AMSGCSWSAFCPYLAGGGSSGGSISSGLLSGRSDNHG
GGSDIQLTQSPSSLSASVGDRVTITCRASESVDSYGISFMNWFQQ
KPGKAPKLLIYAASNQGSGVPSRFSGSGSGTDFTLTISSMQPEDFATYY
CQQSKDVPWTFGQGTKLEIK]

PD-1 1.4 PD001 2001 Amino Acid Sequence:

(SEQ ID NO: 1041)
AMSGCSWSAFCPYLAGGGSSGGSISSGLLSGRSDNHGGGSDIQLTQSPSS
LSASVGDRVTITCRASESVDSYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.4 PD001 2001 (SEQ ID NO: 920)]

(SEQ ID NO: 216)
[CAAGGCCAGTCTGGCCAAGGT][GCGATGAGTGGGTGCTCGTGGT
CTGCTTTTTGCCCGTATTTGGCGGAGGTGGCTCGAGCGGCGGCTC
TATCTCTTCCGGACTGCTGTCCGGCAGATCCGACAATCACGGCGGAGGA
TCCGACATCCAGCTGACCCAGAGCCCTAGCAGCCTGTCTGCCAGCGTGG
GCGACAGAGTGACCATCACCTGTAGAGCCAGCGAGAGCGTGGACAGTTA
CGGCATCAGCTTCATGAACTGGTTCCAGCAGAAGCCCGGCAAGGCCCCC
AAGCTGCTGATCTACGCCGCCAGCAATCAGGGCAGCGGCGTGCCAAGCA
GATTTTCCGGCTCTGGCAGCGGCACCGACTTCACCCTGACCATCAGCAG
CATGCAGCCCGAGGACTTCGCCACCTACTACTGCCAGCAGAGCAAGGAC
GTGCCCTGGACCTTTGGCCAGGGTACCAAGCTGGAAATCAAG]

[Spacer (SEQ ID NO: 362)] [PD-1 1.4 PD002 2001 (SEQ ID NO: 921)]

(SEQ ID NO: 217)
[QGQSGQG][DVNCAIWYSVCTTVPGGGSSGGSISSGLLSGRSDNHG
GGSDIQLTQSPSSLSASVGDRVTITCRASESVDSYGISFMNWFQQ
KPGKAPKLLIYAASNQGSGVPSRFSGSGSGTDFTLTISSMQPEDFATYY
CQQSKDVPWTFGQGTKLEIK]

PD-1 1.4 PD002 2001 Amino Acid Sequence:

(SEQ ID NO: 1042)
DVNCAIWYSVCTTVPGGGSSGGSISSGLLSGRSDNHGGGSDIQLTQSPSS
LSASVGDRVTITCRASESVDSYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.4 PD002 2001 (SEQ ID NO: 922)]

(SEQ ID NO: 218)
[CAAGGCCAGTCTGGCCAAGGT][GATGTTAATTGCGCTATTTGGTA
TTCGGTGTGCACTACTGTTCCTGGAGGTGGCTCGAGCGGCGGCTC
TATCTCTTCCGGACTGCTGTCCGGCAGATCCGACAATCACGGCGGAGGA
TCCGACATCCAGCTGACCCAGAGCCCTAGCAGCCTGTCTGCCAGCGTGG
GCGACAGAGTGACCATCACCTGTAGAGCCAGCGAGAGCGTGGACAGTTA
CGGCATCAGCTTCATGAACTGGTTCCAGCAGAAGCCCGGCAAGGCCCCC
AAGCTGCTGATCTACGCCGCCAGCAATCAGGGCAGCGGCGTGCCAAGCA
GATTTTCCGGCTCTGGCAGCGGCACCGACTTCACCCTGACCATCAGCAG
CATGCAGCCCGAGGACTTCGCCACCTACTACTGCCAGCAGAGCAAGGAC
GTGCCCTGGACCTTTGGCCAGGGTACCAAGCTGGAAATCAAG]

[Spacer (SEQ ID NO: 362)] [PD-1 1.4 PD003 2001 (SEQ ID NO: 923)]

(SEQ ID NO: 219)
[QGQSGQG][LVCPLYALSSGVCMGGGGSSGGSISSGLLSGRSDNHG
GGSDIQLTQSPSSLSASVGDRVTITCRASESVDSYGISFMNWFQQ
KPGKAPKLLIYAASNQGSGVPSRFSGSGSGTDFTLTISSMQPEDFATYY
CQQSKDVPWTFGQGTKLEIK]

PD-1 1.4 PD003 2001 Amino Acid Sequence:

(SEQ ID NO: 1043)
LVCPLYALSSGVCMGGGGSSGGSISSGLLSGRSDNHGGGSDIQLTQSPSS
LSASVGDRVTITCRASESVDSYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.4 PD003 2001 (SEQ ID NO: 924)]

(SEQ ID NO: 220)
[CAAGGCCAGTCTGGCCAAGGT][TTGGTTTGCCCTTTGTATGCATT
GAGTTCTGGGGTGTGCATGGGGGAGGTGGCTCGAGCGGCGGCTC
TATCTCTTCCGGACTGCTGTCCGGCAGATCCGACAATCACGGCGGAGGA

-continued
```
TCCGACATCCAGCTGACCCAGAGCCCTAGCAGCCTGTCTGCCAGCGTGG
GCGACAGAGTGACCATCACCTGTAGAGCCAGCGAGAGCGTGGACAGTTA
CGGCATCAGCTTCATGAACTGGTTCCAGCAGAAGCCCGGCAAGGCCCCC
AAGCTGCTGATCTACGCCGCCAGCAATCAGGGCAGCGGCGTGCCAAGCA
GATTTTCCGGCTCTGGCAGCGGCACCGACTTCACCCTGACCATCAGCAG
CATGCAGCCCGAGGACTTCGCCACCTACTACTGCCAGCAGAGCAAGGAC
GTGCCCTGGACCT
TTGGCCAGGGTACCAAGCTGGAAATCAAG]
```
[Spacer (SEQ ID NO: 362)] [PD-1 1.4 PD008 2001 (SEQ ID NO: 925)]

(SEQ ID NO: 221)
[QGQSGQG][ETCNQYERSSGLCFAGGGSSGGSISSGLLSGRSDNHG
GGSDIQLTQSPSSLSASVGDRVTITCRASESVDSYGISFMNWFQQ
KPGKAPKLLIYAASNQGSGVPSRFSGSGSGTDFTLTISSMQPEDFATYY
CQQSKDVPWTFGQGTKLEIK]

PD-1 1.4 PD008 2001 Amino Acid Sequence:

(SEQ ID NO: 1044)
ETCNQYERSSGLCFAGGGSSGGSISSGLLSGRSDNHGGGSDIQLTQSPSS
LSASVGDRVTITCRASESVDSYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.4 PD008 2001 (SEQ ID NO: 926)]

(SEQ ID NO: 222)
[CAAGGCCAGTCTGGCCAAGGT][GAGACTTGCAATCAGTATGAGAG
GTCGAGTGGTTTGTGCTTTGCGGGAGGTGGCTCGAGCGGCGGCTC
TATCTCTTCCGGACTGCTGTCCGGCAGATCCGACAATCACGGCGGAGGA
TCCGACATCCAGCTGACCCAGAGCCCTAGCAGCCTGTCTGCCAGCGTGG
GCGACAGAGTGACCATCACCTGTAGAGCCAGCGAGAGCGTGGACAGTTA
CGGCATCAGCTTCATGAACTGGTTCCAGCAGAAGCCCGGCAAGGCCCCC
AAGCTGCTGATCTACGCCGCCAGCAATCAGGGCAGCGGCGTGCCAAGCA
GATTTTCCGGCTCTGGCAGCGGCACCGACTTCACCCTGACCATCAGCAG
CATGCAGCCCGAGGACTTCGCCACCTACTACTGCCAGCAGAGCAAGGAC
GTGCCCTGGACCTTTGGCCAGGGTACCAAGCTGGAAATCAAG]

[Spacer (SEQ ID NO: 362)] [PD-1 1.4 PD009 2001 (SEQ ID NO: 927)]

(SEQ ID NO: 223)
[QGQSGQG][APRTCYTYQCSSFYTGGGSSGGSISSGLLSGRSDNHG
GGSDIQLTQSPSSLSASVGDRVTITCRASESVDSYGISFMNWFQQ
KPGKAPKLLIYAASNQGSGVPSRFSGSGSGTDFTLTISSMQPEDFATYY
CQQSKDVPWTFGQGTKLEIK]

PD-1 1.4 PD009 2001 Amino Acid Sequence:

(SEQ ID NO: 1045)
APRTCYTYQCSSFYTGGGSSGGSISSGLLSGRSDNHGGGSDIQLTQSPSS
LSASVGDRVTITCRASESVDSYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.4 PD009 2001 (SEQ ID NO: 928)]

(SEQ ID NO: 224)
[CAAGGCCAGTCTGGCCAAGGT][GCGCCGCGGACGTGCTATACGTA
TCAGTGCTCTAGTTTTTATACTGGAGGTGGCTCGAGCGGCGGCTC
TATCTCTTCCGGACTGCTGTCCGGCAGATCCGACAATCACGGCGGAGGA
TCCGACATCCAGCTGACCCAGAGCCCTAGCAGCCTGTCTGCCAGCGTGG
GCGACAGAGTGACCATCACCTGTAGAGCCAGCGAGAGCGTGGACAGTTA
CGGCATCAGCTTCATGAACTGGTTCCAGCAGAAGCCCGGCAAGGCCCCC
AAGCTGCTGATCTACGCCGCCAGCAATCAGGGCAGCGGCGTGCCAAGCA
GATTTTCCGGCTCTGGCAGCGGCACCGACTTCACCCTGACCATCAGCAG
CATGCAGCCCGAGGACTTCGCCACCTACTACTGCCAGCAGAGCAAGGAC
GTGCCCTGGACCTTTGGCCAGGGTACCAAGCTGGAAATCAAG]

[Spacer (SEQ ID NO: 362)] [PD-1 1.4 PD010 2001 (SEQ ID NO: 929)]

(SEQ ID NO: 225)
[QGQSGQG][GLCSWYLSSSGLCVDGGGSSGGSISSGLLSGRSDNHG
GGSDIQLTQSPSSLSASVGDRVTITCRASESVDSYGISFMNWFQQ
KPGKAPKLLIYAASNQGSGVPSRFSGSGSGTDFTLTISSMQPEDFATYY
CQQSKDVPWTFGQGTKLEIK]

PD-1 1.4 PD010 2001 Amino Acid Sequence:

(SEQ ID NO: 1046)
GLCSWYLSSSGLCVDGGGSSGGSISSGLLSGRSDNHGGGSDIQLTQSPSS
LSASVGDRVTITCRASESVDSYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.4 PD010 2001 (SEQ ID NO: 930)]

(SEQ ID NO: 226)
[CAAGGCCAGTCTGGCCAAGGT][GGTCTTTGCAGTTGGTATCT
TAGTAGTTCGGGTTTGTGCGTGGATGGAGGTGGCTCGAGCGGCGGCTCTA
TCTCTTCCGGACTGCTGTCCGGCAGATCCGACAATCACGGCGGAGGATCC
GACATCCAGCTGACCCAGAGCCCTAGCAGCCTGTCTGCCAGCGTGGGCGA
CAGAGTGACCATCACCTGTAGAGCCAGCGAGAGCGTGGACAGTTACGGCA
TCAGCTTCATGAACTGGTTCCAGCAGAAGCCCGGCAAGGCCCCCAAGCTG

```
CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG]
```

[Spacer (SEQ ID NO: 362)] [PD-1 1.5 PD01 2001 (SEQ ID NO: 931)]

(SEQ ID NO: 227)
```
[QGQSGQG][AMSGCSWSAFCPYLAGGGSSGGSISSGLLSGRSD

NHGGGSDIQLTQSPSSLSASVGDRVTITCRASESVDAYGISFMNWFQQKP

GKAPKLLIYAASNQGSGVPSRFSGSGSGTDFTLTISSMQPEDFATYYCQQ

SKDVPWTFGQGTKLEIK]
```

PD-1 1.5 PD01 2001 Amino Acid Sequence:

(SEQ ID NO: 1047)
```
AMSGCSWSAFCPYLAGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K
```

[Spacer (SEQ ID NO: 918)] [PD-1 1.5 PD001 2001 (SEQ ID NO: 932)]

(SEQ ID NO: 228)
```
[CAAGGCCAGTCTGGCCAAGGT][GCGATGAGTGGGTGCTCGTG

GTCTGCTTTTTGCCCGTATTTGGCGGAGGTGGCTCGAGCGGCGGCTCTA

TCTCTTCCGGACTGCTGTCCGGCAGATCCGACAATCACGGCGGAGGATCC

GATATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG]
```

[Spacer (SEQ ID NO: 362)] [PD-1 1.5 PD002 2001 (SEQ ID NO: 933)]

(SEQ ID NO: 229)
```
[QGQSGQG][DVNCAIWYSVCTTVPGGGSSGGSISSGLLSGRSD

NHGGGSDIQLTQSPSSLSASVGDRVTITCRASESVDAYGISFMNWFQQKP

GKAPKLLIYAASNQGSGVPSRFSGSGSGTDFTLTISSMQPEDFATYYCQQ

SKDVPWTFGQGTKLEIK]
```

PD-1 1.5 PD002 2001 Amino Acid Sequence:

(SEQ ID NO: 1048)
```
DVNCAIWYSVCTTVPGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K
```

[Spacer (SEQ ID NO: 918)] [PD-1 1.5 PD002 2001 (SEQ ID NO: 934)]

(SEQ ID NO: 230)
```
[CAAGGCCAGTCTGGCCAAGGT][GATGTTAATTGCGCTATTTG

GTATTCGGTGTGCACTACTGTTCCTGGAGGTGGCTCGAGCGGCGGCTCTA

TCTCTTCCGGACTGCTGTCCGGCAGATCCGACAATCACGGCGGAGGATCC

GATATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG]
```

[Spacer (SEQ ID NO: 362)] [PD-1 1.5 PD003 2001 (SEQ ID NO: 935)]

(SEQ ID NO: 231)
```
[QGQSGQG][LVCPLYALSSGVCMGGGGSSGGSISSGLLSGRSD

NHGGGSDIQLTQSPSSLSASVGDRVTITCRASESVDAYGISFMNWFQQKP

GKAPKLLIYAASNQGSGVPSRFSGSGSGTDFTLTISSMQPEDFATYYCQQ

SKDVPWTFGQGTKLEIK]
```

PD-1 1.5 PD003 2001 Amino Acid Sequence:

(SEQ ID NO: 1049)
```
LVCPLYALSSGVCMGGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K
```

[Spacer (SEQ ID NO: 918)] [PD-1 1.5 PD003 2001 (SEQ ID NO: 936)]

(SEQ ID NO: 232)
```
[CAAGGCCAGTCTGGCCAAGGT][TTGGTTTGCCCTTTGTATGC

ATTGAGTTCTGGGGTGTGCATGGGGGAGGTGGCTCGAGCGGCGGCTCTA

TCTCTTCCGGACTGCTGTCCGGCAGATCCGACAATCACGGCGGAGGATCC

GATATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC
```

-continued

CCGAGGACTTCGCCACCTACTACTGCCAGCAGAGCAAGGACGTGCCCTGG

ACCTTTGGCCAGGGTACCAAGCTGGAAATCAAG]

[Spacer (SEQ ID NO: 362)] [PD-1 1.5 PD004 2001 (SEQ ID NO: 937)]

(SEQ ID NO: 233)
[QGQSGQG][SVNCRIWSAVCAGYEGGGSSGGSISSGLLSGRSD

NHGGGSDIQLTQSPSSLSASVGDRVTITCRASESVDAYGISFMNWFQQKP

GKAPKLLIYAASNQGSGVPSRFSGSGSGTDFTLTISSMQPEDFATYYCQQ

SKDVPWTFGQGTKLEIK]

PD-1 1.5 PD004 2001 Amino Acid Sequence:

(SEQ ID NO: 1050)
SVNCRIWSAVCAGYEGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K

[Spacer (SEQ ID NO: 918)] [PD-1 1.5 PD004 2001 (SEQ ID NO: 938)]

(SEQ ID NO: 234)
[CAAGGCCAGTCTGGCCAAGGT][TCTGTGAATTGCCGGATTTG

GTCGGCTGTTTGCGCGGGGTATGAGGGAGGTGGCTCGAGCGGCGGCTCTA

TCTCTTCCGGACTGCTGTCCGGCAGATCCGACAATCACGGCGGAGGATCC

GATATCCAGCTGACCCAGAGCCCTAGCAGCCTGTCTGCCAGCGTGGGCGA

CAGAGTGACCATCACCTGTAGAGCCAGCGAGAGCGTGGACGCTTACGGCA

TCAGCTTCATGAACTGGTTCCAGCAGAAGCCCGGCAAGGCCCCCAAGCTG

CTGATCTACGCCGCCAGCAATCAGGGCAGCGGCGTGCCAAGCAGATTTTC

CGGCTCTGGCAGCGGCACCGACTTCACCCTGACCATCAGCAGCATGCAGC

CCGAGGACTTCGCCACCTACTACTGCCAGCAGAGCAAGGACGTGCCCTGG

ACCTTTGGCCAGGGTACCAAGCTGGAAATCAAG]

[Spacer (SEQ ID NO: 362)] [PD-1 1.5 PD005 2001 (SEQ ID NO: 939)]

(SEQ ID NO: 235)
[QGQSGQG][MLVCSLQPTAMCERVGGGSSGGSISSGLLSGRSD

NHGGGSDIQLTQSPSSLSASVGDRVTITCRASESVDAYGISFMNWFQQKP

GKAPKLLIYAASNQGSGVPSRFSGSGSGTDFTLTISSMQPEDFATYYCQQ

SKDVPWTFGQGTKLEIK]

PD-1 1.5 PD005 2001 Amino Acid Sequence:

(SEQ ID NO: 1051)
MLVCSLQPTAMCERVGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K

[Spacer (SEQ ID NO: 918)] [PD-1 1.5 PD005 2001 (SEQ ID NO: 940)]

(SEQ ID NO: 236)
[CAAGGCCAGTCTGGCCAAGGT][ATGCTTGTGTGCTCGTTGCAGCCTAC

TGCGATGTGCGAGCGGGTGGGAGGTGGCTCGAGCGGCGGCTCTATCTCTT

CCGGACTGCTGTCCGGCAGATCCGACAATCACGGCGGAGGATCCGATATC

CAGCTGACCCAGAGCCCTAGCAGCCTGTCTGCCAGCGTGGGCGACAGAGT

GACCATCACCTGTAGAGCCAGCGAGAGCGTGGACGCTTACGGCATCAGCT

TCATGAACTGGTTCCAGCAGAAGCCCGGCAAGGCCCCCAAGCTGCTGATC

TACGCCGCCAGCAATCAGGGCAGCGGCGTGCCAAGCAGATTTTCCGGCTC

TGGCAGCGGCACCGACTTCACCCTGACCATCAGCAGCATGCAGCCCGAGG

ACTTCGCCACCTACTACTGCCAGCAGAGCAAGGACGTGCCCTGGACCTTT

GGCCAGGGTACCAAGCTGGAAATCAAG]

[Spacer (SEQ ID NO: 362)] [PD-1 1.5 PD006 2001 (SEQ ID NO: 941)]

(SEQ ID NO: 237)
[QGQSGQG][APRCYMFASYCKSQYGGGSSGGSISSGLLSGRSDNHGGGS

DIQLTQSPSSLSASVGDRVTITCRASESVDAYGISFMNWFQQKPGKAPKL

LIYAASNQGSGVPSRFSGSGSGTDFTLTISSMQPEDFATYYCQQSKDVPW

TFGQGTKLEIK]

PD-1 1.5 PD006 2001 Amino Acid Sequence:

(SEQ ID NO: 941)
APRCYMFASYCKSQYGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K

[Spacer (SEQ ID NO: 918)] [PD-1 1.5 PD006 2001 (SEQ ID NO: 942)]

(SEQ ID NO: 238)
[CAAGGCCAGTCTGGCCAAGGT][GCGCCTAGGTGCTATATGTTTGCGTC

GTATTGCAAGAGTCAGTATGGAGGTGGCTCGAGCGGCGGCTCTATCTCTT

CCGGACTGCTGTCCGGCAGATCCGACAATCACGGCGGAGGATCCGATATC

CAGCTGACCCAGAGCCCTAGCAGCCTGTCTGCCAGCGTGGGCGACAGAGT

GACCATCACCTGTAGAGCCAGCGAGAGCGTGGACGCTTACGGCATCAGCT

TCATGAACTGGTTCCAGCAGAAGCCCGGCAAGGCCCCCAAGCTGCTGATC

TACGCCGCCAGCAATCAGGGCAGCGGCGTGCCAAGCAGATTTTCCGGCTC

TGGCAGCGGCACCGACTTCACCCTGACCATCAGCAGCATGCAGCCCGAGG

ACTTCGCCACCTACTACTGCCAGCAGAGCAAGGACGTGCCCTGGACCTTT

GGCCAGGGTACCAAGCTGGAAATCAAG]

PD-1 1.5 PD006 2001 Nucleic Acid Sequence:

(SEQ ID NO: 942)
GCGCCTAGGTGCTATATGTTTGCGTCGTATTGCAAGAGTCAGTATGGAGG
TGGCTCGAGCGGCGGCTCTATCTCTTCCGGACTGCTGTCCGGCAGATCCG
ACAATCACGGCGGAGGATCCGATATCCAGCTGACCCAGAGCCCTAGCAGC
CTGTCTGCCAGCGTGGGCGACAGAGTGACCATCACCTGTAGAGCCAGCGA
GAGCGTGGACGCTTACGGCATCAGCTTCATGAACTGGTTCCAGCAGAAGC
CCGGCAAGGCCCCCAAGCTGCTGATCTACGCCGCCAGCAATCAGGGCAGC
GGCGTGCCAAGCAGATTTTCCGGCTCTGGCAGCGGCACCGACTTCACCCT
GACCATCAGCAGCATGCAGCCCGAGGACTTCGCCACCTACTACTGCCAGC
AGAGCAAGGACGTGCCCTGGACCTTTGGCCAGGGTACCAAGCTGGAAATC
AAG

[Spacer (SEQ ID NO: 362)] [PD-1 1.5 PD007 2001 (SEQ ID NO: 943)]

(SEQ ID NO: 239)
[QGQSGQG][VGPCELTPKPVCNTYGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD007 2001 Amino Acid Sequence:

(SEQ ID NO: 1052)
VGPCELTPKPVCNTYGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD007 2001 (SEQ ID NO: 944)]

(SEQ ID NO: 240)
[CAAGGCCAGTCTGGCCAAGGT][GTGGGGCCTTGCGAGTTGACGCCGAA
GCCTGTTTGCAATACGTATGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD008 2001 (SEQ ID NO: 945)]

(SEQ ID NO: 241)
[QGQSGQG][ETCNQYERSSGLCFAGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD008 2001 Amino Acid Sequence:

(SEQ ID NO: 1053)
ETCNQYERSSGLCFAGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD008 2001 (SEQ ID NO: 946)]

(SEQ ID NO: 242)
[CAAGGCCAGTCTGGCCAAGGT][GAGACTTGCAATCAGTATGAGAGGTC
GAGTGGTTTGTGCTTTGCGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD009 2001 (SEQ ID NO: 947)]

(SEQ ID NO: 243)
[QGQSGQG][APRTCYTYQCSSFYTGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD009 2001 Amino Acid Sequence:

(SEQ ID NO: 1054)
APRTCYTYQCSSFYTGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD009 2001 (SEQ ID NO: 948)]

(SEQ ID NO: 244)
[CAAGGCCAGTCTGGCCAAGGT][GCGCCGCGGACGTGCTATACGTATCA
GTGCTCTAGTTTTTATACTGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD010 2001 (SEQ ID NO: 949)]

(SEQ ID NO: 245)
[QGQSGQG][GLCSWYLSSSGLCVDGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD010 2001 Amino Acid Sequence:

(SEQ ID NO: 1055)
GLCSWYLSSSGLCVDGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD010 2001 (SEQ ID NO: 950)]

(SEQ ID NO: 246)
[CAAGGCCAGTCTGGCCAAGGT][GGTCTTTGCAGTTGGTATCTTAGTAG
TTCGGGTTTGTGCGTGGATGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD011 2001 (SEQ ID NO: 951)]

(SEQ ID NO: 247)
[QGQSGQG][VPWCQLTPRVMCMWAGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD011 2001 Amino Acid Sequence:

(SEQ ID NO: 1056)
VPWCQLTPRVMCMWAGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD011 2001 (SEQ ID NO: 952)]

(SEQ ID NO: 248)
[CAAGGCCAGTCTGGCCAAGGT][GTGCCTTGGTGCCAGTTGACGCCGCG
GGTTATGTGCATGTGGGCGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD012 2001 (SEQ ID NO: 953)]

(SEQ ID NO: 249)
[QGQSGQG][NWLDCQFYSECSVYGGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD012 2001 Amino Acid Sequence:

(SEQ ID NO: 953)
NWLDCQFYSECSVYGGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD012 2001 (SEQ ID NO: 954)]

(SEQ ID NO: 250)
[CAAGGCCAGTCTGGCCAAGGT][AATTGGTTGGATTGCCAGTTTTATTC
TGAGTGCTCTGTTTATGGTGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

PD-1 1.5 PD012 2001 Nucleic Acid Sequence:

(SEQ ID NO: 954)
AATTGGTTGGATTGCCAGTTTTATTCTGAGTGCTCTGTTTATGGTGGAGG
TGGCTCGAGCGGCGGCTCTATCTCTTCCGGACTGCTGTCCGGCAGATCCG
ACAATCACGGCGGAGGATCCGATATCCAGCTGACCCAGAGCCCTAGCAGC
CTGTCTGCCAGCGTGGGCGACAGAGTGACCATCACCTGTAGAGCCAGCGA
GAGCGTGGACGCTTACGGCATCAGCTTCATGAACTGGTTCCAGCAGAAGC
CCGGCAAGGCCCCCAAGCTGCTGATCTACGCCGCCAGCAATCAGGGCAGC
GGCGTGCCAAGCAGATTTTCCGGCTCTGGCAGCGGCACCGACTTCACCCT
GACCATCAGCAGCATGCAGCCCGAGGACTTCGCCACCTACTACTGCCAGC
AGAGCAAGGACGTGCCCTGGACCTTTGGCCAGGGTACCAAGCTGGAAATC
AAG

[Spacer (SEQ ID NO: 362)] [PD-1 1.5 PD013 2001 (SEQ ID NO: 955)]

(SEQ ID NO: 251)
[QGQSGQG][SCPLYVMSSFGGCWDGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD013 2001 Amino Acid Sequence:

(SEQ ID NO: 1057)
SCPLYVMSSFGGCWDGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD013 2001 (SEQ ID NO: 956)]

(SEQ ID NO: 252)
[CAAGGCCAGTCTGGCCAAGGT][TCGTGCCCTTTGTATGTGATGTCTAG
TTTTGGTGGGTGCTGGGATGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD014 2001 (SEQ ID NO: 957)]

(SEQ ID NO: 253)
[QGQSGQG][MSHCWMFSSSCDGVKGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD014 2001 Amino Acid Sequence:

(SEQ ID NO: 1058)
MSHCWMFSSSCDGVKGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD014 2001 (SEQ ID NO: 958)]

(SEQ ID NO: 254)
[CAAGGCCAGTCTGGCCAAGGT][ATGAGTCATTGCTGGATGTTTTCGAG
TTCTTGCGATGGGGTGAAGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD015 2001 (SEQ ID NO: 959)]

(SEQ ID NO: 255)
[QGQSGQG][VSYCTWLIEVTCLRGGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD015 2001 Amino Acid Sequence:

(SEQ ID NO: 1059)
VSYCTWLIEVTCLRGGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD015 2001 (SEQ ID NO: 960)]

(SEQ ID NO: 256)
[CAAGGCCAGTCTGGCCAAGGT][GTTTCGTATTGCACGTGGTTGATTGA
GGTGACTTGCCTGAGGGGTGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD016 2001 (SEQ ID NO: 961)]

(SEQ ID NO: 257)
[QGQSGQG][VLCAAYALSSGICGGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD016 2001 Amino Acid Sequence:

(SEQ ID NO: 1060)
VLCAAYALSSGICGGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD016 2001 (SEQ ID NO: 962)]

(SEQ ID NO: 258)
[CAAGGCCAGTCTGGCCAAGGT][GTTTTGTGCGCTGCTTATGCTTTGAG
TTCGGGTATTTGCGGTGGGGAGGTGGCTCGAGCGGCGGCTCTATCTCTT
CCGGACTGCTGTCCGGCAGATCCGACAATCACGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD017 2001 (SEQ ID NO: 963)]

(SEQ ID NO: 259)
[QGQSGQG][TTCNLYQQSSMFCNAGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD017 2001 Amino Acid Sequence:

(SEQ ID NO: 1061)
TTCNLYQQSSMFCNAGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD017 2001 (SEQ ID NO: 964)]

(SEQ ID NO: 260)
[CAAGGCCAGTCTGGCCAAGGT][ACGACTTGCAATCTGTATCAGCAGTC
TTCTATGTTTTGCAATGCTGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD018 2001 (SEQ ID NO: 965)]

(SEQ ID NO: 261)
[QGQSGQG][APRCYMFASYCKSQYGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD018 2001 Amino Acid Sequence:

(SEQ ID NO: 1062)
APRCYMFASYCKSQYGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K]

[Spacer (SEQ ID NO: 918)] [PD-1 1.5 PD018 2001 (SEQ ID NO: 966)]

(SEQ ID NO: 262)
[CAAGGCCAGTCTGGCCAAGGT][GCGCCTAGGTGCTATATGTTTGCGTC
GTATTGCAAGAGTCAGTATGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD019 2001 (SEQ ID NO: 967)]

(SEQ ID NO: 263)
[QGQSGQG][PCDQNPYFYPYVCHAGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD019 2001 Amino Acid Sequence:

(SEQ ID NO: 967)
PCDQNPYFYPYVCHAGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD019 2001 (SEQ ID NO: 968)]

(SEQ ID NO: 264)
[CAAGGCCAGTCTGGCCAAGGT][CCTTGCGATCAGAATCCGTATTTTTA
TCCGTATGTGTGCCATGCGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

PD-1 1.5 PD019 2001 Nucleic Acid Sequence:

(SEQ ID NO: 968)
CCTTGCGATCAGAATCCGTATTTTTATCCGTATGTGTGCCATGCGGGAGG
TGGCTCGAGCGGCGGCTCTATCTCTTCCGGACTGCTGTCCGGCAGATCCG
ACAATCACGGCGGAGGATCCGATATCCAGCTGACCCAGAGCCCTAGCAGC
CTGTCTGCCAGCGTGGGCGACAGAGTGACCATCACCTGTAGAGCCAGCGA
GAGCGTGGACGCTTACGGCATCAGCTTCATGAACTGGTTCCAGCAGAAGC
CCGGCAAGGCCCCCAAGCTGCTGATCTACGCCGCCAGCAATCAGGGCAGC
GGCGTGCCAAGCAGATTTTCCGGCTCTGGCAGCGGCACCGACTTCACCCT
GACCATCAGCAGCATGCAGCCCGAGGACTTCGCCACCTACTACTGCCAGC
AGAGCAAGGACGTGCCCTGGACCTTTGGCCAGGGTACCAAGCTGGAAATC
AAG

[Spacer (SEQ ID NO: 362)] [PD-1 1.5 PD020 2001 (SEQ ID NO: 969)]

(SEQ ID NO: 265)
[QGQSGQG][SVCPMYALSSMLCGAGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD020 2001 Amino Acid Sequence:

(SEQ ID NO: 1063)
SVCPMYALSSMLCGAGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD020 2001 (SEQ ID NO: 970)]

(SEQ ID NO: 266)
[CAAGGCCAGTCTGGCCAAGGT][TCTGTGTGCCCTATGTATGCGTTGAGTTCTATGTTGTGCGGTGCGGGAGGTGGCTCGAGCGGCGGCTCTATCTCTTCCGGACTGCTGTCCGGCAGATCCGACAATCACGGCGGAGGATCCGATATCCAGCTGACCCAGAGCCCTAGCAGCCTGTCTGCCAGCGTGGGCGACAGAGTGACCATCACCTGTAGAGCCAGCGAGAGCGTGGACGCTTACGGCATCAGCTTCATGAACTGGTTCCAGCAGAAGCCCGGCAAGGCCCCCAAGCTGCTGATCTACGCCGCCAGCAATCAGGGCAGCGGCGTGCCAAGCAGATTTTCCGGCTCTGGCAGCGGCACCGACTTCACCCTGACCATCAGCAGCATGCAGCCCGAGGACTTCGCCACCTACTACTGCCAGCAGAGCAAGGACGTGCCCTGGACCTTTGGCCAGGGTACCAAGCTGGAAATCAAG]

[Spacer (SEQ ID NO: 362)] [PD-1 1.5 PD021 2001 (SEQ ID NO: 971)]

(SEQ ID NO: 267)
[QGQSGQG][LSVECYVFSRCSSLPGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK]

PD-1 1.5 PD021 2001 Amino Acid Sequence:

(SEQ ID NO: 1064)
LSVECYVFSRCSSLPGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK]

[Spacer (SEQ ID NO: 918)] [PD-1 1.5 PD021 2001 (SEQ ID NO: 972)]

(SEQ ID NO: 268)
[CAAGGCCAGTCTGGCCAAGGT][TTGTCTGTGGAGTGCTATGTGTTTTCGCGGTGCAGTAGTCTGCCGGGAGGTGGCTCGAGCGGCGGCTCTATCTCTTCCGGACTGCTGTCCGGCAGATCCGACAATCACGGCGGAGGATCCGATATCCAGCTGACCCAGAGCCCTAGCAGCCTGTCTGCCAGCGTGGGCGACAGAGTGACCATCACCTGTAGAGCCAGCGAGAGCGTGGACGCTTACGGCATCAGCTTCATGAACTGGTTCCAGCAGAAGCCCGGCAAGGCCCCCAAGCTGCTGATCTACGCCGCCAGCAATCAGGGCAGCGGCGTGCCAAGCAGATTTTCCGGCTCTGGCAGCGGCACCGACTTCACCCTGACCATCAGCAGCATGCAGCCCGAGGACTTCGCCACCTACTACTGCCAGCAGAGCAAGGACGTGCCCTGGACCTTTGGCCAGGGTACCAAGCTGGAAATCAAG]

[Spacer (SEQ ID NO: 362)] [PD-1 1.5 PD022 2001 (SEQ ID NO: 973)]

(SEQ ID NO: 269)
[QGQSGQG][FYCTYLVSLTCHPQGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK]

PD-1 1.5 PD022 2001 Amino Acid Sequence:

(SEQ ID NO: 1065)
FYCTYLVSLTCHPQGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

[Spacer (SEQ ID NO: 918)] [PD-1 1.5 PD022 2001 (SEQ ID NO: 974)]

(SEQ ID NO: 270)
[CAAGGCCAGTCTGGCCAAGGT][TTTTATTGCACTTATTTGGTGTCTTTGACTTGCCATCCGCAGGGAGGTGGCTCGAGCGGCGGCTCTATCTCTTCCGGACTGCTGTCCGGCAGATCCGACAATCACGGCGGAGGATCCGATATCCAGCTGACCCAGAGCCCTAGCAGCCTGTCTGCCAGCGTGGGCGACAGAGTGACCATCACCTGTAGAGCCAGCGAGAGCGTGGACGCTTACGGCATCAGCTTCATGAACTGGTTCCAGCAGAAGCCCGGCAAGGCCCCCAAGCTGCTGATCTACGCCGCCAGCAATCAGGGCAGCGGCGTGCCAAGCAGATTTTCCGGCTCTGGCAGCGGCACCGACTTCACCCTGACCATCAGCAGCATGCAGCCCGAGGACTTCGCCACCTACTACTGCCAGCAGAGCAAGGACGTGCCCTGGACCTTTGGCCAGGGTACCAAGCTGGAAATCAAG]

[Spacer (SEQ ID NO: 362)] [PD-1 1.5 PD023 2001 (SEQ ID NO: 975)]

(SEQ ID NO: 271)
[QGQSGQG][SMAGCQWSSFCVQRDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK]

PD-1 1.5 PD023 2001 Amino Acid Sequence:

(SEQ ID NO: 1066)
SMAGCQWSSFCVQRDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

[Spacer (SEQ ID NO: 918)] [PD-1 1.5 PD023 2001 (SEQ ID NO: 976)]

(SEQ ID NO: 272)
[CAAGGCCAGTCTGGCCAAGGT][TCTATGGCGGGTTGCCAGTGGAGTTC
GTTTTGCGTGCAGCGGGATGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD024 2001 (SEQ ID NO: 977)]

(SEQ ID NO: 273)
[QGQSGQG][IYSCYMFASRCTSDKGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD024 2001 Amino Acid Sequence:

(SEQ ID NO: 1067)
IYSCYMFASRCTSDKGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K]

[Spacer (SEQ ID NO: 918)] [PD-1 1.5 PD024 2001 (SEQ ID NO: 978)]

(SEQ ID NO: 274)
[CAAGGCCAGTCTGGCCAAGGT][ATTTATTCGTGCTATATGTTTGCTTC
GCGGTGCACGTCTGATAAGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD002 3001 (SEQ ID NO: 979)]

(SEQ ID NO: 275)
[QGQSGQG][DVNCAIWYSVCTTVPGGGSSGGAVGLLAPPGGLSGRSDNH
GGSDIQLTQSPSSLSASVGDRVTITCRASESVDAYGISFMNWFQQKPGKA
PKLLIYAASNQGSGVPSRFSGSGSGTDFTLTISSMQPEDFATYYCQQSKD
VPWTFGQGTKLEIK]

PD-1 1.5 PD002 3001 Amino Acid Sequence:

(SEQ ID NO: 1068)
DVNCAIWYSVCTTVPGGGSSGGAVGLLAPPGGLSGRSDNHGGSDIQLTQS
PSSLSASVGDRVTITCRASESVDAYGISFMNWFQQKPGKAPKLLIYAASN
QGSGVPSRFSGSGSGTDFTLTISSMQPEDFATYYCQQSKDVPWTFGQGTK
LEIK

[Spacer (SEQ ID NO: 918)] [PD-1 1.5 PD002 3001 (SEQ ID NO: 980)]

(SEQ ID NO: 276)
[CAAGGCCAGTCTGGCCAAGGT]CAAGGCCAGTCTGGCCAAGGTGATGTT
AATTGCGCTATTTGGTATTCGGTGTGCACTACTGTTCCTGGAGGTGGCTC
GAGCGGCGGCTCTATCTCTTCCGGACTGCTGTCCGGCAGATCCGACAATC
ACGGCGGAGGATCCGGAGGTGGCTCGAGCGGCGGCGCTGTGGGACTGCTG
GCTCCTCCTGGTGGCCTGTCTGGCAGATCTGATAACCACGGAGGATCCGA
TATCCAGCTGACCCAGAGCCCTAGCAGCCTGTCTGCCAGCGTGGGCGACA
GAGTGACCATCACCTGTAGAGCCAGCGAGAGCGTGGACGCTTACGGCATC
AGCTTCATGAACTGGTTCCAGCAGAAGCCCGGCAAGGCCCCCAAGCTGCT
GATCTACGCCGCCAGCAATCAGGGCAGCGGCGTGCCAAGCAGATTTTCCG
GCTCTGGCAGCGGCACCGACTTCACCCTGACCATCAGCAGCATGCAGCCC
GAGGACTTCGCCACCTACTACTGCCAGCAGAGCAAGGACGTGCCCTGGAC
CTTTGGCCAGGGTACCAAGCTGGAAATCAAG]

[Spacer (SEQ ID NO: 362)] [PD-1 1.5 PD-12 3001 (SEQ ID NO: 981)]

(SEQ ID NO: 277)
[QGQSGQG][NWLDCQFYSECSVYGGGGSSGGAVGLLAPPGGLSGRSDNH
GGSDIQLTQSPSSLSASVGDRVTITCRASESVDAYGISFMNWFQQKPGKA
PKLLIYAASNQGSGVPSRFSGSGSGTDFTLTISSMQPEDFATYYCQQSKD
VPWTFGQGTKLEIK]

PD-1 1.5 PD-12 3001 Amino Acid Sequence:

(SEQ ID NO: 1069)
NWLDCQFYSECSVYGGGGSSGGAVGLLAPPGGLSGRSDNHGGSDIQLTQS
PSSLSASVGDRVTITCRASESVDAYGISFMNWFQQKPGKAPKLLIYAASN
QGSGVPSRFSGSGSGTDFTLTISSMQPEDFATYYCQQSKDVPWTFGQGTK
LEIK]

[Spacer (SEQ ID NO: 918)] [PD-1 1.5 PD-12 3001 (SEQ ID NO: 982)]

(SEQ ID NO: 278)
[CAAGGCCAGTCTGGCCAAGGT][AATTGGTTGGATTGCCAGTTTTATTC
TGAGTGCTCTGTTTATGGTGGAGGTGGCTCGAGCGGCGGCTCTATCTCTT
CCGGACTGCTGTCCGGCAGATCCGACAATCACGGCGGAGGATCCGGAGGT
GGCTCGAGCGGCGGCGCTGTGGGACTGCTGGCTCCTCCTGGTGGCCTGTC
TGGCAGATCTGATAACCACGGAGGATCCGATATCCAGCTGACCCAGAGCC
CTAGCAGCCTGTCTGCCAGCGTGGGCGACAGAGTGACCATCACCTGTAGA
GCCAGCGAGAGCGTGGACGCTTACGGCATCAGCTTCATGAACTGGTTCCA
GCAGAAGCCCGGCAAGGCCCCCAAGCTGCTGATCTACGCCGCCAGCAATC
AGGGCAGCGGCGTGCCAAGCAGATTTTCCGGCTCTGGCAGCGGCACCGAC
TTCACCCTGACCATCAGCAGCATGCAGCCCGAGGACTTCGCCACCTACTA
CTGCCAGCAGAGCAAGGACGTGCCCTGGACCTTTGGCCAGGGTACCAAGC
TGGAAATCAAG]

[Spacer (SEQ ID NO: 362)] [PD-1 1.5 PD-16 3001 (SEQ ID NO: 983)]

(SEQ ID NO: 279)
[QGQSGQG][VLCAAYALSSGICGGGGGSSGGAVGLLAPPGGLSGRSDNH
GGSDIQLTQSPSSLSASVGDRVTITCRASESVDAYGISFMNWFQQKPGKA
PKLLIYAASNQGSGVPSRFSGSGSGTDFTLTISSMQPEDFATYYCQQSKD
VPWTFGQGTKLEIK]

PD-1 1.5 PD-16 3001 Amino Acid Sequence:

(SEQ ID NO: 1070)
VLCAAYALSSGICGGGGGSSGGAVGLLAPPGGLSGRSDNHGGSDIQLTQS
PSSLSASVGDRVTITCRASESVDAYGISFMNWFQQKPGKAPKLLIYAASN
QGSGVPSRFSGSGSGTDFTLTISSMQPEDFATYYCQQSKDVPWTFGQGTK
LEIK

[Spacer (SEQ ID NO: 918)] [PD-1 1.5 PD-16 3001 (SEQ ID NO: 984)]

(SEQ ID NO: 280)
[CAAGGCCAGTCTGGCCAAGGT][GTTTTGTGCGCTGCTTATGCTTTGAG
TTCGGGTATTTGCGGTGGGGAGGTGGCTCGAGCGGCGGCTCTATCTCTT
CCGGACTGCTGTCCGGCAGATCCGACAATCACGGCGGAGGATCCGGAGGT
GGCTCGAGCGGCGGCGCTGTGGGACTGCTGGCTCCTCCTGGTGGCCTGTC
TGGCAGATCTGATAACCACGGAGGATCCGATATCCAGCTGACCCAGAGCC
CTAGCAGCCTGTCTGCCAGCGTGGGCGACAGAGTGACCATCACCTGTAGA
GCCAGCGAGAGCGTGGACGCTTACGGCATCAGCTTCATGAACTGGTTCCA
GCAGAAGCCCGGCAAGGCCCCCAAGCTGCTGATCTACGCCGCCAGCAATC
AGGGCAGCGGCGTGCCAAGCAGATTTTCCGGCTCTGGCAGCGGCACCGAC
TTCACCCTGACCATCAGCAGCATGCAGCCCGAGGACTTCGCCACCTACTA
CTGCCAGCAGAGCAAGGACGTGCCCTGGACCTTTGGCCAGGGTACCAAGC
TGGAAATCAAG]

[Spacer (SEQ ID NO: 362)] [PD-1 1.5 PD025 2001 (SEQ ID NO: 985)]

(SEQ ID NO: 281)
[QGQSGQG][SRCSVYEVSSGLCDWGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD025 2001 Amino Acid Sequence:

(SEQ ID NO: 1071)
SRCSVYEVSSGLCDWGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD025 2001 (SEQ ID NO: 986)]

(SEQ ID NO: 282)
[CAAGGCCAGTCTGGCCAAGGT][TCTCGTTGCTCTGTGTATGAGGTTTC
GTCGGGGCTGTGCGATTGGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD026 2001 (SEQ ID NO: 987)]

(SEQ ID NO: 283)
[QGQSGQG][GMCSAYAYSSKLCTIGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD026 2001 Amino Acid Sequence:

(SEQ ID NO: 1072)
GMCSAYAYSSKLCTIGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI

[Spacer (SEQ ID NO: 918)] [PD-1 1.5 PD026 2001 (SEQ ID NO: 988)]

(SEQ ID NO: 284)
[CAAGGCCAGTCTGGCCAAGGT][GGGATGTGCTCGGCGTATGCTTATTC
GAGTAAGTTGTGCACTATTGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD027 2001 (SEQ ID NO: 989)]

(SEQ ID NO: 285)
[QGQSGQG][MTTNTCNLLCQQFLTGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD027 2001 Amino Acid Sequence:

(SEQ ID NO: 1073)
MTTNTCNLLCQQFLTGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K]

[Spacer (SEQ ID NO: 918)] [PD-1 1.5 PD027 2001 (SEQ ID NO: 990)]

(SEQ ID NO: 286)
[CAAGGCCAGTCTGGCCAAGGT][ATGACTACGAATACTTGCAATCTGTT
GTGCCAGCAGTTTTTGACGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD028 2001 (SEQ ID NO: 991)]

(SEQ ID NO: 287)
[QGQSGQG][FQPCLMFASSCFTSKGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD028 2001 Amino Acid Sequence:

(SEQ ID NO: 991)
FQPCLMFASSCFTSKGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD028 2001 (SEQ ID NO: 992)]

(SEQ ID NO: 288)
[CAAGGCCAGTCTGGCCAAGGT][TTTCAGCCGTGCCTGATGTTTGCGAG
TAGTTGCTTTACTAGTAAGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

PD-1 1.5 PD028 2001 Nucleic Acid Sequence:

(SEQ ID NO: 992)
TTTCAGCCGTGCCTGATGTTTGCGAGTAGTTGCTTTACTAGTAAGGGAGG
TGGCTCGAGCGGCGGCTCTATCTCTTCCGGACTGCTGTCCGGCAGATCCG
ACAATCACGGCGGAGGATCCGATATCCAGCTGACCCAGAGCCCTAGCAGC
CTGTCTGCCAGCGTGGGCGACAGAGTGACCATCACCTGTAGAGCCAGCGA
GAGCGTGGACGCTTACGGCATCAGCTTCATGAACTGGTTCCAGCAGAAGC
CCGGCAAGGCCCCCAAGCTGCTGATCTACGCCGCCAGCAATCAGGGCAGC
GGCGTGCCAAGCAGATTTTCCGGCTCTGGCAGCGGCACCGACTTCACCCT
GACCATCAGCAGCATGCAGCCCGAGGACTTCGCCACCTACTACTGCCAGC
AGAGCAAGGACGTGCCCTGGACCTTTGGCCAGGGTACCAAGCTGGAAATC
AAG

[Spacer (SEQ ID NO: 362)] [PD-1 1.5 PD030 2001 (SEQ ID NO: 993)]

(SEQ ID NO: 289)
[QGQSGQG][ALCSMYLASSGLCNKGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD030 2001 Amino Acid Sequence:

(SEQ ID NO: 1074)
ALCSMYLASSGLCNKGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 918)] [PD-1 1.5 PD030 2001 (SEQ ID NO: 994)]

(SEQ ID NO: 290)
[CAAGGCCAGTCTGGCCAAGGT][GCGCTTTGCAGTATGTATCTTGCTAG
TTCTGGGCTGTGCAATAAGGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD033 2001 (SEQ ID NO: 995)]

(SEQ ID NO: 291)
[QGQSGQG][EFCARDWLPYQCSSFGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD-1 1.5 PD033 2001 Amino Acid Sequence:

(SEQ ID NO: 1075)
EFCARDWLPYQCSSFGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K]

[Spacer (SEQ ID NO: 918)] [PD-1 1.5 PD033 2001 (SEQ ID NO: 996)]

(SEQ ID NO: 292)
[CAAGGCCAGTCTGGCCAAGGT][GAGTTTTGCGCTCGGGATTGGCTGCC
GTATCAGTGCTCGAGTTTTGGAGGTGGCTCGAGCGGCGGCTCTATCTCTT
CCGGACTGCTGTCCGGCAGATCCGACAATCACGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD-1 1.5 PD034 2001 (SEQ ID NO: 1028)]

(SEQ ID NO: 1029)
[QGQSGQG][TSYCSIEHYPCNTHHGGGSSGGSISSGLLSGRSDNHG
GGSDIQLTQSPSSLSASVGDRVTITCRASESVDAYGISFMNWFQQ
KPGKAPKLLIYAASNQGSGVPSRFSGSGSGTDFTLTISSMQPEDFATYY
CQQSKDVPWTFGQGTKLEIK]

PD-1 1.5 PD034 2001 Amino Acid Sequence:

(SEQ ID NO: 1028)
TSYCSIEHYPCNTHHGGGSSGGSISSGLLSGRSDNHGGGSDIQLTQSPS
SLSASVGDRVTITCRASESVDAYGISFMNWFQQKPGKAPKLLIYAASNQ
GSGVPSRFSGSGSGTDFTLTISSMQPEDFATYYCQQSKDVPWTFGQGTK
LEIK

[Spacer (SEQ ID NO: 918)] [PD-1 1.5 PD034 2001 (SEQ ID NO: 1030)

(SEQ ID NO: 1031)
[CAAGGCCAGTCTGGCCAAGGT][ACGTCATACTGCAGTATTGAGCAT
TACCCCTGCAATACACATCATGGAGGTGGCTCGAGCGGCGGCTCTATCTC
TTCCGGACTGCTGTCCGGCAGATCCGACAATCACGGCGGAGGATCCGATA
TCCAGCTGACCCAGAGCCCTAGCAGCCTGTCTGCCAGCGTGGGCGACAG
AGTGACCATCACCTGTAGAGCCAGCGAGAGCGTGGACGCTTACGGCATC
AGCTTCATGAACTGGTTCCAGCAGAAGCCCGGCAAGGCCCCCAAGCTGC
TGATCTACGCCGCCAGCAATCAGGGCAGCGGCGTGCCAAGCAGATTTTC
CGGCTCTGGCAGCGGCACCGACTTCACCCTGACCATCAGCAGCATGCAG
CCCGAGGACTTCGCCACCTACTACTGCCAGCAGAGCAAGGACGTGCCC
TGGACCTTTGGCCAGGGTACCAAGCTGGAAATCAAG]

PD-1 1.5 PD034 2001 Nucleic Acid Sequence:

(SEQ ID NO: 1030)
ACGTCATACTGCAGTATTGAGCATTACCCCTGCAATACACATCATGGAG

GTGGCTCGAGCGGCGGCTCTATCTCTTCCGGACTGCTGTCCGGCAGATC

CGACAATCACGGCGGAGGATCCGATATCCAGCTGACCCAGAGCCCTAGC

AGCCTGTCTGCCAGCGTGGGCGACAGAGTGACCATCACCTGTAGAGCCA

GCGAGAGCGTGGACGCTTACGGCATCAGCTTCATGAACTGGTTCCAGCA

GAAGCCCGGCAAGGCCCCCAAGCTGCTGATCTACGCCGCCAGCAATCAG

GGCAGCGGCGTGCCAAGCAGATTTTCCGGCTCTGGCAGCGGCACCGACT

TCACCCTGACCATCAGCAGCATGCAGCCCGAGGACTTCGCCACCTACTA

CTGCCAGCAGAGCAAGGACGTGCCCTGGACCTTTGGCCAGGGTACCAAG

CTGGAAATCAAG

[Spacer (SEQ ID NO: 362)] [PD-1 1.5 PD035 2001 (SEQ ID NO: 997)]

(SEQ ID NO: 293)
[QGQSGQG][PYICSSFPLDCQAGQGGGSSGGSISSGLLSGRSDNHGG

GSDIQLTQSPSSLSASVGDRVTITCRASESVDAYGISFMNWFQQKPGKAP

KLLIYAASNQGSVPSRFSGSGSGTDFTLTISSMQPEDFATYYCQQSKDV

PWTFGQGTKLEIK]

PD-1 1.5 PD035 2001 Amino Acid Sequence:

(SEQ ID NO: 1076)
PYICSSFPLDCQAGQGGGSSGGSISSGLLSGRSDNHGGGSDIQLTQSPS

SLSASVGDRVTITCRASESVDAYGISFMNWFQQKPGKAPKLLIYAASNQ

GSGVPSRFSGSGSGTDFTLTISSMQPEDFATYYCQQSKDVPWTFGQGTK

LEIK]

[Spacer (SEQ ID NO: 918)] [PD-1 1.5 PD035 2001 (SEQ ID NO: 998)]

(SEQ ID NO: 584)
[CAAGGCCAGTCTGGCCAAGGT][CCTTATATTTGCTCTAGTTTTCCGTT

GGATTGCCAGGCGGGTCAGGGAGGTGGCTCGAGCGGCGGCTCTATCTCTT

CCGGACTGCTGTCCGGCAGATCCGACAATCACGGCGGAGGATCCGATATC

CAGCTGACCCAGAGCCCTAGCAGCCTGTCTGCCAGCGTGGGCGACAGAG

TGACCATCACCTGTAGAGCCAGCGAGAGCGTGGACGCTTACGGCATCAG

CTTCATGAACTGGTTCCAGCAGAAGCCCGGCAAGGCCCCCAAGCTGCTG

ATCTACGCCGCCAGCAATCAGGGCAGCGGCGTGCCAAGCAGATTTTCCG

GCTCTGGCAGCGGCACCGACTTCACCCTGACCATCAGCAGCATGCAGCC

CGAGGACTTCGCCACCTACTACTGCCAGCAGAGCAAGGACGTGCCCTGG

ACCTTTGGCCAGGGTACCAAGCTGGAAATCAAG]

Example 9: Anti-PD-1 Activatable Antibodies of the Disclosure

This example demonstrates that anti-PD-1 activatable antibodies of the disclosure can be made in a variety of combinations of MM, CM, VL, and VH domains, as well as in a variety of distinct Ig isotypes. In addition, this example demonstrates that anti-PD-1 activatable antibodies of the disclosure can be made in a variety of combinations of MM, CM, VLCDR1, VLCDR2, VLCDR3, VHCDR1, VHCDR2, and VHCDR3 domains, as well as in a variety of distinct Ig isotypes.

TABLE 13A

| Mask Sequence | Substrates: | VL SEQ ID NO: | VH SEQ ID NO: | VL CDRs SEQ ID NO: CDR1 | CDR2 | CDR3 | VH CDRs SEQ ID NO: CDR1 | CDR2 | CDR3 |
|---|---|---|---|---|---|---|---|---|---|
| AMSGCSWSAFCPYLA (SEQ ID NO: 66) | LSGRSDNH (SEQ ID NO: 294) | 1 | 3 | 653 | 658 | 664 | 669 | 678 | 683 |
| DVNCAIWYSVCITVP (SEQ ID NO: 67) | TGRGPSWV (SEQ ID NO: 295) | 5 | 7 | 654 | 659 | 665 | 670 | 679 | 684 |
| LVCPLYALSSGVCMG (SEQ ID NO: 68) | PLTGRSGG (SEQ ID NO: 296) | 9 | 11 | 655 | 660 | 666 | 671 | 680 | 685 |
| SVNCRIWSAVCAGYE (SEQ ID NO: 69) | TARGPSFK (SEQ ID NO: 297) | 13 | 15 | 656 | 661 | 667 | 672 | 681 | 686 |
| MLVCSLQPTAMCERV (SEQ ID NO: 70) | NTLSGRSENHSG (SEQ ID NO: 298) | 17 | 19 | 657 | 662 | 668 | 673 | 682 | 687 |
| APRCYMFASYCKSQY (SEQ ID NO: 71) | NTLSGRSGNHGS (SEQ ID NO: 299) | 21 | 39 | | 663 | | 674 | | |
| VGPCELTPKPVCNTY (SEQ ID NO: 72) | TSTSGRSANPRG (SEQ ID NO: 300) | 23 | 41 | | | | 675 | | |
| ETCNQYERSSGLCFA (SEQ ID NO: 73) | TSGRSANP (SEQ ID NO: 301) | 25 | 43 | | | | 676 | | |
| APRTCYTYQCSSFYT (SEQ ID NO: 74) | VHMPLGFLGP (SEQ ID NO: 302) | 27 | 45 | | | | 677 | | |

TABLE 13A-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| GLCSWYLSSSGLCVD (SEQ ID NO: 75) | AVGLLAPP (SEQ ID NO: 303) | 29 | 47 | VL CDRs of SEQ ID NO: 1 | VH CDRs of SEQ ID NO: 3 |
| VPWCQLTPRVMCMWA (SEQ ID NO: 76) | AQNLLGMV (SEQ ID NO: 304) | 31 | 49 | VL CDRs of SEQ ID NO: 5 | VH CDRs of SEQ ID NO: 7 |
| NWLDCQFYSECSVYG (SEQ ID NO: 77) | QNQALRMA (SEQ ID NO: 305) | 33 | 51 | VL CDRs of SEQ ID NO: 9 | VH CDRs of SEQ ID NO: 11 |
| SCPLYVMSSFGGCWD (SEQ ID NO: 78) | LAAPLGLL (SEQ ID NO: 306) | 35 | 53 | VL CDRs of SEQ ID NO: 13 | VH CDRs of SEQ ID NO: 15 |
| MSHCWMFSSSCDGVK (SEQ ID NO: 79) | STFPFGMF (SEQ ID NO: 307) | 37 | 55 | VL CDRs of SEQ ID NO: 17 | VH CDRs of SEQ ID NO: 19 |
| VSYCTWLIEVICLRG (SEQ ID NO: 80) | ISSGLLSS (SEQ ID NO: 308) | | 57 | VL CDRs of SEQ ID NO: 21 | VH CDRs of SEQ ID NO: 39 |
| VLCAAYALSSGICGG (SEQ ID NO: 81) | PAGLWLDP (SEQ ID NO: 309) | | 59 | VL CDRs of SEQ ID NO: 23 | VH CDRs of SEQ ID NO: 41 |
| TTCNLYQQSSMFCNA (SEQ ID NO: 82) | VAGRSMRP (SEQ ID NO: 310) | | | VL CDRs of SEQ ID NO: 25 | VH CDRs of SEQ ID NO: 43 |
| APRCYMFASYCKSQY (SEQ ID NO: 83) | VVPEGRRS (SEQ ID NO: 311) | | | VL CDRs of SEQ ID NO: 27 | VH CDRs of SEQ ID NO: 45 |
| PCDQNPYFYPYVCHA (SEQ ID NO: 84) | ILPRSPAF (SEQ ID NO: 312) | | | VL CDRs of SEQ ID NO: 29 | VH CDRs of SEQ ID NO: 47 |
| SVCPMYALSSMLCGA (SEQ ID NO: 85) | MVLGRSLL (SEQ ID NO: 313) | | | VL CDRs of SEQ ID NO: 31 | VH CDRs of SEQ ID NO: 49 |
| LSVECYVFSRCSSLP (SEQ ID NO: 86) | QGRAITFI (SEQ ID NO: 314) | | | VL CDRs of SEQ ID NO: 33 | VH CDRs of SEQ ID NO: 51 |
| FYCTYLVSLTCHPQ (SEQ ID NO: 87) | SPRSIMLA (SEQ ID NO: 315) | | | VL CDRs of SEQ ID NO: 35 | VH CDRs of SEQ ID NO: 53 |
| SMAGCQWSSFCVQRD (SEQ ID NO: 88) | SMLRSMPL (SEQ ID NO: 316) | | | VL CDRs of SEQ ID NO: 37 | VH CDRs of SEQ ID NO: 55 |
| IYSCYMFASRCTSDK (SEQ ID NO: 89) | SARGPSRW (SEQ ID NO: 319) | | | | VH CDRs of SEQ ID NO: 57 |
| SRCSVYEVSSGLCDW (SEQ ID NO: 90) | GWHTGRN (SEQ ID NO: 320) | | | | VH CDRs of SEQ ID NO: 59 |
| GMCSAYAYSSKLCTI (SEQ ID NO: 91) | HTGRSGAL (SEQ ID NO: 321) | | | LC CDRs of SEQ ID NO: 543 | HC CDRs of SEQ ID NO: 546 |
| MTTNTCNLLCQQFLT (SEQ ID NO: 92) | AARGPAIH (SEQ ID NO: 322) | | | | |
| FQPCLMFASSCFTSK (SEQ ID NO: 93) | RGPAFNPM (SEQ ID NO: 323) | | | | |
| WNCHPAGVGPVFCEV (SEQ ID NO: 94) | SSRGPAYL (SEQ ID NO: 324) | | | | |
| ALCSMYLASSGLCNK (SEQ ID NO: 95) | RGPATPIM (SEQ ID NO: 325) | | | | |
| NYLSCQFFQNCYETY (SEQ ID NO: 96) | RGPA (SEQ ID NO: 326) | | | | |
| GWCLFSDMWLGLCSA (SEQ ID NO: 97) | GGQPSGMWGW (SEQ ID NO: 327) | | | | |
| EFCARDWLPYQCSSF (SEQ ID NO: 98) | FPRPLGITGL (SEQ ID NO: 328) | | | | |
| TSYCSIEHYPCNTHH (SEQ ID NO: 99) | SPLTGRSG (SEQ ID NO: 329) | | | | |

TABLE 13A-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| PYICSSFPLDCQAGQ (SEQ ID NO: 100) | SAGFSLPA (SEQ ID NO: 330) | | | | |
| VGCEWYMSSSGMCSR (SEQ ID NO: 101) | LAPLGLQRR (SEQ ID NO: 331) | | | | |
| EVCGGCSMQSVSCWP (SEQ ID NO: 102) | SGGPLGVR (SEQ ID NO: 332) | | | | |
| FTECQLSPKAICMSN (SEQ ID NO: 103) | PLGL (SEQ ID NO: 333) | | | | |
| KYCLFSEYVEGTCLN (SEQ ID NO: 104) | ISSGLSS (SEQ ID NO: 334) | | | | |
| SGCPMYAWGWDECWR (SEQ ID NO: 105) | PVGYTSSL (SEQ ID NO: 335) | | | | |
| VDCPWYASSSAICSR (SEQ ID NO: 106) | DWLYWPGI (SEQ ID NO: 336) | | | | |
| DMLLCQIRGSCAAWG (SEQ ID NO: 107) | LKAAPRWA (SEQ ID NO: 337) | | | | |
| ECHPYQASASLWCGY (SEQ ID NO: 108) | GPSHLVLT (SEQ ID NO: 338) | | | | |
| MMMGCMWSAWCPPSR (SEQ ID NO: 109) | LPGGLSPW (SEQ ID NO: 339) | | | | |
| NAYFRCSLMCNMIMF (SEQ ID NO: 110) | MGLFSEAG (SEQ ID NO: 340) | | | | |
| ACCKESVHSVHDCKR (SEQ ID NO: 111) | SPLPLRVP (SEQ ID NO: 341) | | | | |
| ACIGINSYMSNYCYL (SEQ ID NO: 112) | RMHLRSLG (SEQ ID NO: 342) | | | | |
| ANCSFLELTNKFCTI (SEQ ID NO: 113) | LLAPSHRA (SEQ ID NO: 343) | | | | |
| AYCSYLMFASNPCII (SEQ ID NO: 114) | GPRSFGL (SEQ ID NO: 344) | | | | |
| CFTSKCPCLCYSLLA (SEQ ID NO: 115) | GPRSFG (SEQ ID NO: 345) | | | | |
| CLCRDINCWLGCSKT (SEQ ID NO: 116) | LSGRSGNH (SEQ ID NO: 1157) | | | | |
| CWCDIYCSPYQCSSF (SEQ ID NO: 117) | SGRSANPRG (SEQ ID NO: 1158) | | | | |
| DCIYYYQQSANLCSY (SEQ ID NO: 118) | LSGRSDDH (SEQ ID NO: 1161) | | | | |
| DCTGVNYYIDKHCIN (SEQ ID NO: 119) | LSGRSDIH (SEQ ID NO: 1162) | | | | |
| DECHGYLRSSGLCGG (SEQ ID NO: 120) | LSGRSDQH (SEQ ID NO: 1165) | | | | |
| DICSAYAASSGFCYY (SEQ ID NO: 121) | LSGRSDTH (SEQ ID NO: 1166) | | | | |
| DIICVLIPTAWCGRT (SEQ ID NO: 122) | LSGRSDYH (SEQ ID NO: 1169) | | | | |
| DNCCMYCSWWIACRD (SEQ ID NO: 123) | LSGRSDNP (SEQ ID NO: 1520) | | | | |
| DSCQWYMLSADLCGT (SEQ ID NO: 124) | LSGRSANP (SEQ ID NO: 1695) | | | | |

TABLE 13A-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| DSVCFSSSSFLCHKS (SEQ ID NO: 125) | LSGRSANI (SEQ ID NO: 1696) | | | | |
| DTMCAIWWTVCSGGR (SEQ ID NO: 126) | LSGRSDNI (SEQ ID NO: 1697) | | | | |
| ECTYQTSSFHEACMS (SEQ ID NO: 127) | MIAPVAYR (SEQ ID NO: 1698) | | | | |
| EGCNLYERSSYGCNN (SEQ ID NO: 128) | RPSPMWAY (SEQ ID NO: 1699) | | | | |
| EGCTAFAMSAGICGG (SEQ ID NO: 129) | WATPRPMR (SEQ ID NO: 1700) | | | | |
| EQSCSLTPIAFCWSE (SEQ ID NO: 130) | FRLLDWQW (SEQ ID NO: 1701) | | | | |
| EWCNAYISSSKLCST (SEQ ID NO: 131) | ISSGL (SEQ ID NO: 1702) | | | | |
| FEVCYMFASACRNGM (SEQ ID NO: 132) | ISSGLLS (SEQ ID NO: 1703) | | | | |
| FSCSWYAESSSLCDI (SEQ ID NO: 133) | ISSGLL (SEQ ID NO: 1704) | | | | |
| FVCQMFEASSGLCGG (SEQ ID NO: 134) | ISSGLLSGRSDNH (SEQ ID NO: 214) | | | | |
| FYCPCCMFASSCGSR (SEQ ID NO: 135) | AVGLLAPPGGLSGRSDNH (SEQ ID NO: 318) | | | | |
| FYCSYLPGASHQCSH (SEQ ID NO: 136) | ISSGLLSSGGSGGSLSGRSDNH (SEQ ID NO: 346) | | | | |
| FYCSYLYMCEVCCYE (SEQ ID NO: 137) | ISSGLLSSGGSGGSLSGRSDNH (SEQ ID NO: 346) | | | | |
| GFCTQHTVLTWCPTS (SEQ ID NO: 138) | AVGLLAPPGGTSTSGRSANPRG (SEQ ID NO: 347) | | | | |
| GSCPSYAVSAGLCYA (SEQ ID NO: 139) | TSTSGRSANPRGGGAVGLLAPP (SEQ ID NO: 348) | | | | |
| GSQCFLTPTAFCTHT (SEQ ID NO: 140) | VHMPLGFLGPGGTSTSGRSANPRG (SEQ ID NO: 349) | | | | |
| GTCHPYMQSSKICNN (SEQ ID NO: 141) | TSTSGRSANPRGGGVHMPLGFLGP (SEQ ID NO: 350) | | | | |
| GVECFVFTGGCGGYG (SEQ ID NO: 142) | LSGRSDNHGGAVGLLAPP (SEQ ID NO: 351) | | | | |
| HELCNGHWVPCCWAY (SEQ ID NO: 143) | VHMPLGFLGPGGLSGRSDNH (SEQ ID NO: 352) | | | | |
| ICDSYYAVSSGLCLL (SEQ ID NO: 144) | LSGRSDNHGGVHMPLGFLGP (SEQ ID NO: 353) | | | | |
| IGCAWYVSSAGWCSP (SEQ ID NO: 145) | LSGRSDNHGGSGGSISSGLLSS (SEQ ID NO: 354) | | | | |
| INLCWMFASECGEHH (SEQ ID NO: 146) | LSGRSGNHGGSGGSISSGLLSS (SEQ ID NO: 355) | | | | |
| KCWLAEMTNLEHCNM (SEQ ID NO: 147) | ISSGLLSSGGSGGSLSGRSGNH (SEQ ID NO: 356) | | | | |
| KHCSDFAYSSRLCDR (SEQ ID NO: 148) | LSGRSDNHGSGGSQNQALRMA (SEQ ID NO: 357) | | | | |
| KVCSSYASSSGLCGW (SEQ ID NO: 149) | QNQALRMAGGSGGSLSGRSDNH (SEQ ID NO: 358) | | | | |

TABLE 13A-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| LDS CYMFASYCVQAV (SEQ ID NO: 150) | LSGRSGNHGGSGGSQNQALRMA (SEQ ID NO: 359) | | | | |
| LLACHPIFVTVCQTR (SEQ ID NO: 151) | QNQALRMAGGSGGSLSGRSGNH (SEQ ID NO: 360) | | | | |
| LLSCPYNPEHVCHTS (SEQ ID NO: 152) | ISSGLLSGRSGNH (SEQ ID NO: 361) | | | | |
| LMCSLYALSSNLCGR (SEQ ID NO: 153) | ISSGLLSSGGSGGSLSGRNH (SEQ ID NO: 1091) | | | | |
| LMWCVLFLWSWCCRI (SEQ ID NO: 154) | ISSGLLSGRSANPRG (SEQ ID NO: 1092) | | | | |
| LPI CHLTPTAVCTHI (SEQ ID NO: 155) | AVGLLAPPTSGRSANPRG (SEQ ID NO: 1093) | | | | |
| LSNMCLAFGSCLYAW (SEQ ID NO: 156) | AVGLLAPPSGRSANPRG (SEQ ID NO: 1094) | | | | |
| LSRCHPIWYTICQNP (SEQ ID NO: 157) | ISSGLLSGRSDDH (SEQ ID NO: 1095) | | | | |
| LTQCMSVHKECGGYE (SEQ ID NO: 158) | ISSGLLSGRSDIH (SEQ ID NO: 1096) | | | | |
| LVNCRIWSWVCEEAT (SEQ ID NO: 159) | ISSGLLSGRSDQH (SEQ ID NO: 1097) | | | | |
| LYCSWYQMSSAVCKE (SEQ ID NO: 160) | ISSGLLSGRSDTH (SEQ ID NO: 1098) | | | | |
| MECGWYALSARFCEV (SEQ ID NO: 161) | ISSGLLSGRSDYH (SEQ ID NO: 1099) | | | | |
| MTCSPYAMSAHFCNE (SEQ ID NO: 162) | ISSGLLSGRSDNP (SEQ ID NO: 1100) | | | | |
| MVCSLYAYSASLCGA (SEQ ID NO: 163) | ISSGLLSGRSANP (SEQ ID NO: 1101) | | | | |
| NALCWSTFSWWCDMD (SEQ ID NO: 164) | ISSGLLSGRSANI (SEQ ID NO: 1102) | | | | |
| NFTCMLTPKAYCVQT (SEQ ID NO: 165) | AVGLLAPPGGLSGRSDDH (SEQ ID NO: 1103) | | | | |
| NGACIFILSWCINKT (SEQ ID NO: 166) | AVGLLAPPGGLSGRSDIH (SEQ ID NO: 1104) | | | | |
| NGCELYAAASGLCRT (SEQ ID NO: 167) | AVGLLAPPGGLSGRSDQH (SEQ ID NO: 1105) | | | | |
| NIECSVFGRCCCDNY (SEQ ID NO: 168) | AVGLLAPPGGLSGRSDTH (SEQ ID NO: 1106) | | | | |
| PACRPMFWNRSCDNI (SEQ ID NO: 169) | AVGLLAPPGGLSGRSDYH (SEQ ID NO: 1107) | | | | |
| PCRVSNMFFPYNCLD (SEQ ID NO: 170) | AVGLLAPPGGLSGRSDNP (SEQ ID NO: 1108) | | | | |
| PIMCMLLPESYCWIW (SEQ ID NO: 171) | AVGLLAPPGGLSGRSANP (SEQ ID NO: 1109) | | | | |
| PQSCYMFASLCMPNG (SEQ ID NO: 172) | AVGLLAPPGGLSGRSANI (SEQ ID NO: 1110) | | | | |
| PRCPQGLPLYQCSSF (SEQ ID NO: 173) | ISSGLLSGRSDNI (SEQ ID NO: 1111) | | | | |
| PSVECLVFKRCYALP (SEQ ID NO: 174) | AVGLLAPPGGLSGRSDNI (SEQ ID NO: 1112) | | | | |

TABLE 13A-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| PVCQRSATIYNCNWF (SEQ ID NO: 175) | | | | | |
| QCAAYYISSFGGCSN (SEQ ID NO: 176) | | | | | |
| QFGCFMLARDFCGTY (SEQ ID NO: 177) | | | | | |
| QMMCPYNPEHKCHQK (SEQ ID NO: 178) | | | | | |
| QRECWMFASSCNSKN (SEQ ID NO: 179) | | | | | |
| QSNMCITYICSSFNY (SEQ ID NO: 180) | | | | | |
| QSRCHSLAPYLCSSF (SEQ ID NO: 181) | | | | | |
| RAYCSLLFADSCNNN (SEQ ID NO: 182) | | | | | |
| RCIGINQYIDSNCYN (SEQ ID NO: 183) | | | | | |
| RLSCFMFASQCALEF (SEQ ID NO: 184) | | | | | |
| RQCIILMNHRQCFFK (SEQ ID NO: 185) | | | | | |
| RSCTPYMMSSSLCNT (SEQ ID NO: 186) | | | | | |
| RYCHYWKMPYECSSF (SEQ ID NO: 187) | | | | | |
| SCVSLSWFDMLKCYE (SEQ ID NO: 188) | | | | | |
| SDNCEIWWTVCSAAM (SEQ ID NO: 189) | | | | | |
| SFCWSYLVSSGLCGV (SEQ ID NO: 190) | | | | | |
| SMCMNNYGTTIMCGN (SEQ ID NO: 191) | | | | | |
| SMVGCGWSTFCPSRG (SEQ ID NO: 192) | | | | | |
| SSLHCANGHTCPFCL (SEQ ID NO: 193) | | | | | |
| SVCSYYEESSGICSP (SEQ ID NO: 194) | | | | | |
| SWCGWYAASSGVCAL (SEQ ID NO: 195) | | | | | |
| TCISQTIDSYLNCVN (SEQ ID NO: 196) | | | | | |
| TFCNLYTKSSNICMS (SEQ ID NO: 197) | | | | | |
| TYCVFHEYLDNTCNN (SEQ ID NO: 198) | | | | | |
| VATGCPNLMLCGSWP (SEQ ID NO: 199) | | | | | |

TABLE 13A-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| VEYCSLLLGNRCDYW (SEQ ID NO: 200) | | | | | |
| VGCNMYLMSAGLCVD (SEQ ID NO: 201) | | | | | |
| VLYCSWDSGTCVGSH (SEQ ID NO: 202) | | | | | |
| VMFSCYYLETCAPGV (SEQ ID NO: 203) | | | | | |
| VRIGLCPESCLVSGF (SEQ ID NO: 204) | | | | | |
| VTCTYYATSSSLCNT (SEQ ID NO: 205) | | | | | |
| VTGCILLPKAWCWGD (SEQ ID NO: 206) | | | | | |
| VWCSIYEYSSNLCSR (SEQ ID NO: 207) | | | | | |
| WMLECQYNNTCNNMT (SEQ ID NO: 208) | | | | | |
| WPCSPLEYYNNICNV (SEQ ID NO: 209) | | | | | |
| WTYDCHLNQTCPTYY (SEQ ID NO: 210) | | | | | |
| YCSINMYLIGGNCMY (SEQ ID NO: 211) | | | | | |
| YFCSLYANSAGFCGG (SEQ ID NO: 212) | | | | | |
| YVSCYMFSSSCPSTW (SEQ ID NO: 213) | | | | | |

TABLE 13B

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| RYCHAANPDRFCGIY (SEQ ID NO: 1206) | LSGRSDNH (SEQ ID NO: 294) | 626 | 1346 | VL CDRs of SEQ ID NO: 626 | VH CDRs of SEQ ID NO: 1346 |
| PRVCSTDGGDYCLLP (SEQ ID NO: 1207) | TGRGPSWV (SEQ ID NO: 295) | | | 1705 1706 1707 | 1708 1709 1710 |
| PRPQCHHRHNCPDHP (SEQ ID NO: 1208) | PLTGRSGG (SEQ ID NO: 296) | | | | |
| KCSRPAHQNPDRCSR (SEQ ID NO: 1209) | TARGPSFK (SEQ ID NO: 297) | | | | |
| ASYRCPDYKCSHTKH (SEQ ID NO: 1210) | NTLSGRSENHSG (SEQ ID NO: 298) | | | | |
| LPRCPDHPIKCIETK (SEQ ID NO: 1211) | NTLSGRSGNHGS (SEQ ID NO: 299) | | | | |
| YTFGCPDRYCDRAAT (SEQ ID NO: 1212) | TSTSGRSANPRG (SEQ ID NO: 300) | | | | |

TABLE 13B-continued

|  |  | VL SEQ ID NO: | VH SEQ ID NO: | VL CDRs SEQ ID NO: | | | VH CDRs SEQ ID NO: | | |
|---|---|---|---|---|---|---|---|---|---|
| Mask Sequence | Substrates: | | | CDR1 | CDR2 | CDR3 | CDR1 | CDR2 | CDR3 |
| RGCPDFNPPSHCYTA (SEQ ID NO: 1213) | TSGRSANP (SEQ ID NO: 301) | | | | | | | | |
| RDYCGPQSPDYCHEI (SEQ ID NO: 1214) | VHMPLGFLGP (SEQ ID NO: 302) | | | | | | | | |
| PNKPCPDLQCYVTNY (SEQ ID NO: 1215) | AVGLLAPP (SEQ ID NO: 303) | | | | | | | | |
| PRVACGEPDLCYSNT (SEQ ID NO: 1216) | AQNLLGMV (SEQ ID NO: 304) | | | | | | | | |
| RGCKKHTISTLTCPD (SEQ ID NO: 1217) | QNQALRMA (SEQ ID NO: 305) | | | | | | | | |
| PAYRCPDRPPCKNQM (SEQ ID NO: 1218) | LAAPLGLL (SEQ ID NO: 306) | | | | | | | | |
| NARCYPYFGDNCHMN (SEQ ID NO: 1220) | STFPFGMF (SEQ ID NO: 307) | | | | | | | | |
| PTLRCPDRWCYDSPR (SEQ ID NO: 1221) | ISSGLLSS (SEQ ID NO: 308) | | | | | | | | |
| PSNLCPDKWCQTWRS (SEQ ID NO: 1222) | PAGLWLDP (SEQ ID NO: 309) | | | | | | | | |
| TPRYCAASYCPAHGY (SEQ ID NO: 1223) | VAGRSMRP (SEQ ID NO: 310) | | | | | | | | |
| RPGCGAVSPRCPDAP (SEQ ID NO: 1224) | VVPEGRRS (SEQ ID NO: 311) | | | | | | | | |
| VLRCHKQNPDNCNNH (SEQ ID NO: 1225) | ILPRSPAF (SEQ ID NO: 312) | | | | | | | | |
| GVKSCREPDFCSRGS (SEQ ID NO: 1226) | MVLGRSLL (SEQ ID NO: 313) | | | | | | | | |
| RNNLCPDYSCNNHNS (SEQ ID NO: 1227) | QGRAITFI (SEQ ID NO: 314) | | | | | | | | |
| RAACHRLNPDACTNG (SEQ ID NO: 1228) | SPRSIMLA (SEQ ID NO: 315) | | | | | | | | |
| VCQSDRIPDYVICTD (SEQ ID NO: 1229) | SMLRSMPL (SEQ ID NO: 316) | | | | | | | | |
| RNCRIASINPDYCNI (SEQ ID NO: 1230) | SARGPSRW (SEQ ID NO: 319) | | | | | | | | |
| KEWRCPDYKCKPSYH (SEQ ID NO: 1231) | GWHTGRN (SEQ ID NO: 320) | | | | | | | | |
| NLRICHKSLCPDYIK (SEQ ID NO: 1232) | HTGRSGAL (SEQ ID NO: 321) | | | | | | | | |
| NTHKCSNTNICPSFN (SEQ ID NO: 1233) | AARGPAIH (SEQ ID NO: 322) | | | | | | | | |
| STRYCQASQCQMSPY (SEQ ID NO: 1234) | RGPAFNPM (SEQ ID NO: 323) | | | | | | | | |
| THRFCTASLCNKNTS (SEQ ID NO: 1235) | SSRGPAYL (SEQ ID NO: 324) | | | | | | | | |
| YTLCNTRSPDWCPNK (SEQ ID NO: 1236) | RGPATPIM (SEQ ID NO: 325) | | | | | | | | |
| IRCTTGQSPDYCPQS (SEQ ID NO: 1237) | RGPA (SEQ ID NO: 326) | | | | | | | | |
| RCNQPDKNDQMLCNI (SEQ ID NO: 1238) | GGQPSGMWGW (SEQ ID NO: 327) | | | | | | | | |

TABLE 13B-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| GTCRTDHQSPDYCYY (SEQ ID NO: 1239) | FPRPLGITGL (SEQ ID NO: 328) | | | | |
| RGCFRSGDSLGMCPD (SEQ ID NO: 1240) | SPLTGRSG (SEQ ID NO: 329) | | | | |
| SGCFDSNEHRHCSRI (SEQ ID NO: 1241) | SAGFSLPA (SEQ ID NO: 330) | | | | |
| NRCMKLWYNPDCVAR (SEQ ID NO: 1242) | LAPLGLQRR (SEQ ID NO: 331) | | | | |
| PLCARPHYWSPCDQS (SEQ ID NO: 1243) | SGGPLGVR (SEQ ID NO: 332) | | | | |
| DSKCHPNSPDYCFNS (SEQ ID NO: 1244) | PLGL (SEQ ID NO: 333) | | | | |
| NGSCRPLGGDFCGNR (SEQ ID NO: 1245) | ISSGLSS (SEQ ID NO: 334) | | | | |
| KTRCIEMSGDYCAKS (SEQ ID NO: 1246) | PVGYTSSL (SEQ ID NO: 335) | | | | |
| IRPCMYNWGDLCNQF (SEQ ID NO: 1247) | DWLYWPGI (SEQ ID NO: 336) | | | | |
| VKTCMENNPDYCYNN (SEQ ID NO: 1248) | LKAAPRWA (SEQ ID NO: 337) | | | | |
| LRMCFEASGDYCDQQ (SEQ ID NO: 1249) | GPSHLVLT (SEQ ID NO: 338) | | | | |
| IRKCQLDGPDQCMLT (SEQ ID NO: 1250) | LPGGLSPW (SEQ ID NO: 339) | | | | |
| KWKCHKNNPNYCNNR (SEQ ID NO: 1251) | MGLFSEAG (SEQ ID NO: 340) | | | | |
| RTMCLDTNPDYCQSH (SEQ ID NO: 1252) | SPLPLRVP (SEQ ID NO: 341) | | | | |
| LAACHSMDSHRCPDY (SEQ ID NO: 1253) | RMHLRSLG (SEQ ID NO: 342) | | | | |
| RSPCIHNATMCPDYT (SEQ ID NO: 1254) | LLAPSHRA (SEQ ID NO: 343) | | | | |
| MPRCPDWPPRCSMVI (SEQ ID NO: 1255) | GPRSFGL (SEQ ID NO: 344) | | | | |
| VRQLCRLPDYCPSGK (SEQ ID NO: 1256) | GPRSFG (SEQ ID NO: 345) | | | | |
| PRPPCAQSLNCPDRA (SEQ ID NO: 1257) | LSGRSGNH (SEQ ID NO: 1157) | | | | |
| SFGRCTLVRTCPDFM (SEQ ID NO: 1258) | SGRSANPRG (SEQ ID NO: 1158) | | | | |
| RDKPCPDFSCATIHY (SEQ ID NO: 1259) | LSGRSDDH (SEQ ID NO: 1161) | | | | |
| ATKPCPDRWCTMSTL (SEQ ID NO: 1260) | LSGRSDIH (SEQ ID NO: 1162) | | | | |
| SSNRCPDLRCTHHNM (SEQ ID NO: 1261) | LSGRSDQH (SEQ ID NO: 1165) | | | | |
| RGSMCPDLHCSLSHI (SEQ ID NO: 1262) | LSGRSDTH (SEQ ID NO: 1166) | | | | |
| NYQRCPDRTCMHNII (SEQ ID NO: 1263) | LSGRSDYH (SEQ ID NO: 1169) | | | | |

TABLE 13B-continued

| Mask Sequence | Substrates: | VL SEQ ID NO: | VH SEQ ID NO: | VL CDRs SEQ ID NO: CDR1 | CDR2 | CDR3 | VH CDRs SEQ ID NO: CDR1 | CDR2 | CDR3 |
|---|---|---|---|---|---|---|---|---|---|
| QKRPCPDRKCHAHYN (SEQ ID NO: 1264) | LSGRSDNP (SEQ ID NO: 1520) | | | | | | | | |
| QNHRCPDRWCNKTTN (SEQ ID NO: 1265) | LSGRSANP (SEQ ID NO: 1695) | | | | | | | | |
| RLNLCPDKHCHMTNL (SEQ ID NO: 1266) | LSGRSANI (SEQ ID NO: 1696) | | | | | | | | |
| PQDRCPDKRCTNPGN (SEQ ID NO: 1267) | LSGRSDNI (SEQ ID NO: 1697) | | | | | | | | |
| SRWRCPDYKCEHGKY (SEQ ID NO: 1268) | MIAPVAYR (SEQ ID NO: 1698) | | | | | | | | |
| YENQCPDLYCNRYSM (SEQ ID NO: 1269) | RPSPMWAY (SEQ ID NO: 1699) | | | | | | | | |
| TARSCPVFNCPDNNS (SEQ ID NO: 1270) | WATPRPMR (SEQ ID NO: 1700) | | | | | | | | |
| MDQRCPDAWCTSKPK (SEQ ID NO: 1271) | FRLLDWQW (SEQ ID NO: 1701) | | | | | | | | |
| GDLRCPDRLCPRHSL (SEQ ID NO: 1272) | ISSGL (SEQ ID NO: 1702) | | | | | | | | |
| IQYLCPDYHCKASNN (SEQ ID NO: 1273) | ISSGLLS (SEQ ID NO: 1703) | | | | | | | | |
| QHHRCPDRYCNSNNN (SEQ ID NO: 1274) | ISSGLL (SEQ ID NO: 1704) | | | | | | | | |
| TVALCPDYSCYHINN (SEQ ID NO: 1275) | ISSGLLSGRSDNH (SEQ ID NO: 214) | | | | | | | | |
| SPWRCPDRYCLSNHD (SEQ ID NO: 1276) | AVGLLAPPGGLSGRSDNH (SEQ ID NO: 318) | | | | | | | | |
| SSKRCPDRFCNKTHA (SEQ ID NO: 1277) | ISSGLLSSGGSGGSLSGRSDNH (SEQ ID NO: 346) | | | | | | | | |
| HTDRCPDYKCSQNHF (SEQ ID NO: 1278) | ISSGLLSSGGSGGSLSGRSDNH (SEQ ID NO: 346) | | | | | | | | |
| SRSNCTPQRCNSDYH (SEQ ID NO: 1279) | AVGLLAPPGGTSTSGRSANPRG (SEQ ID NO: 347) | | | | | | | | |
| FAARCPDKYCAIHTN (SEQ ID NO: 1280) | TSTSGRSANPRGGGAVGLLAPP (SEQ ID NO: 348) | | | | | | | | |
| GSARCPDLVCQQTKQ (SEQ ID NO: 1281) | VHMPLGFLGPGGTSTSGRSANPRG (SEQ ID NO: 349) | | | | | | | | |
| RNLMCPDKFCNKNTK (SEQ ID NO: 1282) | TSTSGRSANPRGGGVHMPLGFLGP (SEQ ID NO: 350) | | | | | | | | |
| NIRLCPDKVCTPTWV (SEQ ID NO: 1283) | LSGRSDNHGGAVGLLAPP (SEQ ID NO: 351) | | | | | | | | |
| MTDLCPDAHCAKTHM (SEQ ID NO: 1284) | VHMPLGFLGPGGLSGRSDNH (SEQ ID NO: 352) | | | | | | | | |
| PYSRLCAYPCPDFVG (SEQ ID NO: 1285) | LSGRSDNHGGVHMPLGFLGP (SEQ ID NO: 353) | | | | | | | | |
| LCGCARSPDYCKCRG (SEQ ID NO: 1286) | LSGRSDNHGGSGGSISSGLLSS (SEQ ID NO: 354) | | | | | | | | |
| WGRCERVPDCCCPRG (SEQ ID NO: 1287) | LSGRSGNHGGSGGSISSGLLSS (SEQ ID NO: 355) | | | | | | | | |
| TRNTCHTRICYGMAC (SEQ ID NO: 1288) | ISSGLLSSGGSGGSLSGRSGNH (SEQ ID NO: 356) | | | | | | | | |

TABLE 13B-continued

| Mask Sequence | Substrates: | VL SEQ ID NO: | VH SEQ ID NO: | VL CDRs SEQ ID NO: CDR1 | CDR2 | CDR3 | VH CDRs SEQ ID NO: CDR1 | CDR2 | CDR3 |
|---|---|---|---|---|---|---|---|---|---|
| CVCTSCSSYWTLCPD (SEQ ID NO: 1289) | LSGRSDNHGGSGGSQNQALRMA (SEQ ID NO: 357) | | | | | | | | |
| LCCSRGSNCPDRCTW (SEQ ID NO: 1290) | QNQALRMAGGSGGSLSGRSDNH (SEQ ID NO: 358) | | | | | | | | |
| CCPLCQANMCPDNQS (SEQ ID NO: 1291) | LSGRSGNHGGSGGSQNQALRMA (SEQ ID NO: 359) | | | | | | | | |
| ECKLCCPDLYCGGTM (SEQ ID NO: 1292) | QNQALRMAGGSGGSLSGRSGNH (SEQ ID NO: 360) | | | | | | | | |
| CSNPMCAYCCPDLIL (SEQ ID NO: 1293) | ISSGLLSGRSGNH (SEQ ID NO: 361) | | | | | | | | |
| CPRCNTYSKHDCYHQ (SEQ ID NO: 1294) | ISSGLLSSGGSGGSLSGRNH (SEQ ID NO: 1091) | | | | | | | | |
| FCCASKMPAPSNCHT (SEQ ID NO: 1295) | ISSGLLSGRSANPRG (SEQ ID NO: 1092) | | | | | | | | |
| | AVGLLAPPTSGRSANPRG (SEQ ID NO: 1093) | | | | | | | | |
| | AVGLLAPPSGRSANPRG (SEQ ID NO: 1094) | | | | | | | | |
| | ISSGLLSGRSDDH (SEQ ID NO: 1095) | | | | | | | | |
| | ISSGLLSGRSDIH (SEQ ID NO: 1096) | | | | | | | | |
| | ISSGLLSGRSDQH (SEQ ID NO: 1097) | | | | | | | | |
| | ISSGLLSGRSDTH (SEQ ID NO: 1098) | | | | | | | | |
| | ISSGLLSGRSDYH (SEQ ID NO: 1099) | | | | | | | | |
| | ISSGLLSGRSDNP (SEQ ID NO: 1100) | | | | | | | | |
| | ISSGLLSGRSANP (SEQ ID NO: 1101) | | | | | | | | |
| | ISSGLLSGRSANI (SEQ ID NO: 1102) | | | | | | | | |
| | AVGLLAPPGGLSGRSDDH (SEQ ID NO: 1103) | | | | | | | | |
| | AVGLLAPPGGLSGRSDIH (SEQ ID NO: 1104) | | | | | | | | |
| | AVGLLAPPGGLSGRSDQH (SEQ ID NO: 1105) | | | | | | | | |
| | AVGLLAPPGGLSGRSDTH (SEQ ID NO: 1106) | | | | | | | | |
| | AVGLLAPPGGLSGRSDYH (SEQ ID NO: 1107) | | | | | | | | |
| | AVGLLAPPGGLSGRSDNP (SEQ ID NO: 1108) | | | | | | | | |
| | AVGLLAPPGGLSGRSANP (SEQ ID NO: 1109) | | | | | | | | |
| | AVGLLAPPGGLSGRSANI (SEQ ID NO: 1110) | | | | | | | | |

TABLE 13B-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| | ISSGLLSGRSDNI (SEQ ID NO: 1111) | | | | |
| | AVGLLAPPGGLSGRSDNI (SEQ ID NO: 1112) | | | | |

TABLE 13C

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| GCDFTSAKHNCGSGW (SEQ ID NO: 1351) | LSGRSDNH (SEQ ID NO: 294) | 638 | 1514 | VL CDRs of SEQ ID NO: 638 | VH CDRs of SEQ ID NO: 1514 |
| VGSNCWTGPACALTS (SEQ ID NO: 1352) | TGRGPSWV (SEQ ID NO: 295) | | | 1711 1712 1713 | 1714 1715 1716 |
| FCAVMFDFLSDRCLH (SEQ ID NO: 1353) | PLTGRSGG (SEQ ID NO: 296) | | | | |
| FCPPWLDYLGNKCMT (SEQ ID NO: 1354) | TARGPSFK (SEQ ID NO: 297) | | | | |
| MSCWDFSSAQGCGQH (SEQ ID NO: 1355) | NTLSGRSENHSG (SEQ ID NO: 298) | | | | |
| LMCADLHYNHYNCKY (SEQ ID NO: 1356) | NTLSGRSGNHGS (SEQ ID NO: 299) | | | | |
| ELCGWQSFSGVCTSE (SEQ ID NO: 1357) | TSTSGRSANPRG (SEQ ID NO: 300) | | | | |
| WTYENCWASCQPHLE (SEQ ID NO: 1358) | TSGRSANP (SEQ ID NO: 301) | | | | |
| KLTEDFSSAA (SEQ ID NO: 1359) | VHMPLGFLGP (SEQ ID NO: 302) | | | | |
| VGQSCFSGLVCDRQL (SEQ ID NO: 1360) | AVGLLAPP (SEQ ID NO: 303) | | | | |
| ISHYCFSGKSCRD (SEQ ID NO: 1361) | AQNLLGMV (SEQ ID NO: 304) | | | | |
| HCIPDFTSAAGDCMR (SEQ ID NO: 1362) | QNQALRMA (SEQ ID NO: 305) | | | | |
| RLVSAYSFS (SEQ ID NO: 1363) | LAAPLGLL (SEQ ID NO: 306) | | | | |
| KFHHSHPLVHDFTSA (SEQ ID NO: 1364) | STFPFGMF (SEQ ID NO: 307) | | | | |
| ASYPDFSSANGVGLR (SEQ ID NO: 1365) | ISSGLLSS (SEQ ID NO: 308) | | | | |
| GLATTLSNVDFTSAG (SEQ ID NO: 1366) | PAGLWLDP (SEQ ID NO: 309) | | | | |
| DFTSANSAFSGDAST (SEQ ID NO: 1367) | VAGRSMRP (SEQ ID NO: 310) | | | | |
| GRLPGHSVVDFTSAW (SEQ ID NO: 1368) | VVPEGRRS (SEQ ID NO: 311) | | | | |
| SGSFYSSSAFDFTSA (SEQ ID NO: 1369) | ILPRSPAF (SEQ ID NO: 312) | | | | |

TABLE 13C-continued

| Mask Sequence | Substrates: | VL SEQ ID NO: | VH SEQ ID NO: | VL CDRs SEQ ID NO: CDR1 | CDR2 | CDR3 | VH CDRs SEQ ID NO: CDR1 | CDR2 | CDR3 |
|---|---|---|---|---|---|---|---|---|---|
| CDDFTSAQHSRINEC (SEQ ID NO: 1370) | MVLGRSLL (SEQ ID NO: 313) | | | | | | | | |
| CDFTSAQGKKCRTAL (SEQ ID NO: 1371) | QGRAITFI (SEQ ID NO: 314) | | | | | | | | |
| YYIDKYQSPSYGPVL (SEQ ID NO: 1372) | SPRSIMLA (SEQ ID NO: 315) | | | | | | | | |
| FSVARARSSADFTSS (SEQ ID NO: 1373) | SMLRSMPL (SEQ ID NO: 316) | | | | | | | | |
| DSDFTSAGSADSRSR (SEQ ID NO: 1374) | SARGPSRW (SEQ ID NO: 319) | | | | | | | | |
| CDFTSATSISKRCDH (SEQ ID NO: 1375) | GWHTGRN (SEQ ID NO: 320) | | | | | | | | |
| IESSASSWGLQASRN (SEQ ID NO: 1376) | HTGRSGAL (SEQ ID NO: 321) | | | | | | | | |
| PRYHNLNFTTPALSPGS (SEQ ID NO: 1377) | AARGPAIH (SEQ ID NO: 322) | | | | | | | | |
| DLFARFPLDRDFTSA (SEQ ID NO: 1378) | RGPAFNPM (SEQ ID NO: 323) | | | | | | | | |
| HCNFTTPPYCSSTLW (SEQ ID NO: 1379) | SSRGPAYL (SEQ ID NO: 324) | | | | | | | | |
| NVPIILLTDRQLLSG (SEQ ID NO: 1380) | RGPATPIM (SEQ ID NO: 325) | | | | | | | | |
| NPTACDFTSSMATYC (SEQ ID NO: 1381) | RGPA (SEQ ID NO: 326) | | | | | | | | |
| FVRTVRFSNSMFSVP (SEQ ID NO: 1382) | GGQPSGMWGW (SEQ ID NO: 327) | | | | | | | | |
| YDFSSASNSSPSRQT (SEQ ID NO: 1383) | FPRPLGITGL (SEQ ID NO: 328) | | | | | | | | |
| AHPDFSSAMRGNLLG (SEQ ID NO: 1384) | SPLTGRSG (SEQ ID NO: 329) | | | | | | | | |
| SSHVVHKDFTSANSR (SEQ ID NO: 1385) | SAGFSLPA (SEQ ID NO: 330) | | | | | | | | |
| CPDFTSANGGGCWQM (SEQ ID NO: 1386) | LAPLGLQRR (SEQ ID NO: 331) | | | | | | | | |
| SLGQSYPTDFTCPGC (SEQ ID NO: 1387) | SGGPLGVR (SEQ ID NO: 332) | | | | | | | | |
| ASMRSHEQRDFTSAY (SEQ ID NO: 1388) | PLGL (SEQ ID NO: 333) | | | | | | | | |
| SCQFWFTLCSGGVFH (SEQ ID NO: 1389) | ISSGLSS (SEQ ID NO: 334) | | | | | | | | |
| PYPNNRTGMHDFTSA (SEQ ID NO: 1390) | PVGYTSSL (SEQ ID NO: 335) | | | | | | | | |
| KPFPIDFTSAGTSGT (SEQ ID NO: 1391) | DWLYWPGI (SEQ ID NO: 336) | | | | | | | | |
| SIKSFIPRDDFTSAA (SEQ ID NO: 1392) | LKAAPRWA (SEQ ID NO: 337) | | | | | | | | |
| GIKNPATPFVDFTSA (SEQ ID NO: 1393) | GPSHLVLT (SEQ ID NO: 338) | | | | | | | | |
| LSHTYPRGSSTIEAS (SEQ ID NO: 1394) | LPGGLSPW (SEQ ID NO: 339) | | | | | | | | |

TABLE 13C-continued

|  |  | VL SEQ ID NO: | VH SEQ ID NO: | VL CDRs SEQ ID NO: | | | VH CDRs SEQ ID NO: | | |
|---|---|---|---|---|---|---|---|---|---|
| Mask Sequence | Substrates: | | | CDR1 | CDR2 | CDR3 | CDR1 | CDR2 | CDR3 |
| PSLDFSSAT (SEQ ID NO: 1395) | MGLFSEAG (SEQ ID NO: 340) | | | | | | | | |
| AFTPRIAPTFDVMKE (SEQ ID NO: 1396) | SPLPLRVP (SEQ ID NO: 341) | | | | | | | | |
| LCGLQIPPDCERS (SEQ ID NO: 1397) | RMHLRSLG (SEQ ID NO: 342) | | | | | | | | |
| AAKMVSHSERDFTSA (SEQ ID NO: 1398) | LLAPSHRA (SEQ ID NO: 343) | | | | | | | | |
| VSVECFSGMQCPHYY (SEQ ID NO: 1399) | GPRSFGL (SEQ ID NO: 344) | | | | | | | | |
| ASKCRLPCMASTQIY (SEQ ID NO: 1400) | GPRSFG (SEQ ID NO: 345) | | | | | | | | |
| GLRSCNIYFSIPCTY (SEQ ID NO: 1401) | LSGRSGNH (SEQ ID NO: 1157) | | | | | | | | |
| RGTSDGTLDFTTARS (SEQ ID NO: 1402) | SGRSANPRG (SEQ ID NO: 1158) | | | | | | | | |
| SMYPSASRLLHPQYP (SEQ ID NO: 1403) | LSGRSDDH (SEQ ID NO: 1161) | | | | | | | | |
| HCISCYDFTSAAGSF (SEQ ID NO: 1404) | LSGRSDIH (SEQ ID NO: 1162) | | | | | | | | |
| SSGRWGDAWACARIC (SEQ ID NO: 1405) | LSGRSDQH (SEQ ID NO: 1165) | | | | | | | | |
| RVFSDFTSASHSFGG (SEQ ID NO: 1406) | LSGRSDTH (SEQ ID NO: 1166) | | | | | | | | |
| TDRHSASGRDFTSAH (SEQ ID NO: 1407) | LSGRSDYH (SEQ ID NO: 1169) | | | | | | | | |
| AHCEDFSSAERIATMGC (SEQ ID NO: 1408) | LSGRSDNP (SEQ ID NO: 1520) | | | | | | | | |
| ACDPYSFSIPCDDRL (SEQ ID NO: 1409) | LSGRSANP (SEQ ID NO: 1695) | | | | | | | | |
| NSPFTLSHIYDR (SEQ ID NO: 1410) | LSGRSANI (SEQ ID NO: 1696) | | | | | | | | |
| IGINFTTPSAFVAFP (SEQ ID NO: 1411) | LSGRSDNI (SEQ ID NO: 1697) | | | | | | | | |
| RDAFPIYRNADFSTP (SEQ ID NO: 1412) | MIAPVAYR (SEQ ID NO: 1698) | | | | | | | | |
| SIPNASSYNFTSSSG (SEQ ID NO: 1413) | RPSPMWAY (SEQ ID NO: 1699) | | | | | | | | |
| AGIPDKRHTYDFTSA (SEQ ID NO: 1414) | WATPRPMR (SEQ ID NO: 1700) | | | | | | | | |
| WPLAHDSRDWNFTTP (SEQ ID NO: 1415) | FRLLDWQW (SEQ ID NO: 1701) | | | | | | | | |
| RHSPSSGHVDFTSAG (SEQ ID NO: 1416) | ISSGL (SEQ ID NO: 1702) | | | | | | | | |
| SCFAWTDPVWNRCSW (SEQ ID NO: 1417) | ISSGLLS (SEQ ID NO: 1703) | | | | | | | | |
| MPCDWTGPGKIWCGG (SEQ ID NO: 1418) | ISSGLL (SEQ ID NO: 1704) | | | | | | | | |
| RDCDFSTANFRSCNK (SEQ ID NO: 1419) | ISSGLLSGRSDNH (SEQ ID NO: 214) | | | | | | | | |

TABLE 13C-continued

| Mask Sequence | Substrates: | VL SEQ ID NO: | VH SEQ ID NO: | VL CDRs SEQ ID NO: CDR1 CDR2 CDR3 | VH CDRs SEQ ID NO: CDR1 CDR2 CDR3 |
|---|---|---|---|---|---|
| LSCVVSPNYLHCNDH (SEQ ID NO: 1420) | AVGLLAPPGGLSGRSDNH (SEQ ID NO: 318) | | | | |
| FVCGLYSFSGVCQGV (SEQ ID NO: 1421) | ISSGLLSSGGSGGSLSGRSDNH (SEQ ID NO: 346) | | | | |
| IGLMCFSGLQCPMLA (SEQ ID NO: 1422) | ISSGLLSSGGSGGSLSGRSDNH (SEQ ID NO: 346) | | | | |
| PGMNCFSGEICQMST (SEQ ID NO: 1423) | AVGLLAPPGGTSTSGRSANPRG (SEQ ID NO: 347) | | | | |
| GDVGSCWASCGLQGG (SEQ ID NO: 1424) | TSTSGRSANPRGGGAVGLLAPP (SEQ ID NO: 348) | | | | |
| SQFQDCWASCGASFT (SEQ ID NO: 1425) | VHMPLGFLGPGGTSTSGRSANPRG (SEQ ID NO: 349) | | | | |
| VGSLNCWYSCGDIWL (SEQ ID NO: 1426) | TSTSGRSANPRGGGVHMPLGFLGP (SEQ ID NO: 350) | | | | |
| MCESWLNFLGDQCGM (SEQ ID NO: 1427) | LSGRSDNHGGAVGLLAPP (SEQ ID NO: 351) | | | | |
| RCMISQSSFSGMCGM (SEQ ID NO: 1428) | VHMPLGFLGPGGLSGRSDNH (SEQ ID NO: 352) | | | | |
| NCAPWTSNMSNHCLK (SEQ ID NO: 1429) | LSGRSDNHGGVHMPLGFLGP (SEQ ID NO: 353) | | | | |
| LCGVGSATGLELCGV (SEQ ID NO: 1430) | LSGRSDNHGGSGGSISSGLLSS (SEQ ID NO: 354) | | | | |
| GCDFSSLGGRQPCTP (SEQ ID NO: 1431) | LSGRSGNHGGSGGSISSGLLSS (SEQ ID NO: 355) | | | | |
| MGCNFTTYPYHTCNT (SEQ ID NO: 1432) | ISSGLLSSGGSGGSLSGRSGNH (SEQ ID NO: 356) | | | | |
| GSCDFTSGAGKKCGS (SEQ ID NO: 1433) | LSGRSDNHGGSGGSQNQALRMA (SEQ ID NO: 357) | | | | |
| VSCDFTSSHARMCSR (SEQ ID NO: 1434) | QNQALRMAGGSGGSLSGRSDNH (SEQ ID NO: 358) | | | | |
| MRCIDFYYNHINCIG (SEQ ID NO: 1435) | LSGRSGNHGGSGGSQNQALRMA (SEQ ID NO: 359) | | | | |
| RSCDFTSAANKYCAT (SEQ ID NO: 1436) | QNQALRMAGGSGGSLSGRSGNH (SEQ ID NO: 360) | | | | |
| LYCDSFSVPRPNCAP (SEQ ID NO: 1437) | ISSGLLSGRSGNH (SEQ ID NO: 361) | | | | |
| NSCDFTSARVSKCST (SEQ ID NO: 1438) | ISSGLLSSGGSGGSLSGRNH (SEQ ID NO: 1091) | | | | |
| STCSDNFTTPMPCNT (SEQ ID NO: 1439) | ISSGLLSGRSANPRG (SEQ ID NO: 1092) | | | | |
| DICNDRPNLTHCHYF (SEQ ID NO: 1440) | AVGLLAPPTSGRSANPRG (SEQ ID NO: 1093) | | | | |
| LRCDDFTSAIGCRGY (SEQ ID NO: 1441) | AVGLLAPPSGRSANPRG (SEQ ID NO: 1094) | | | | |
| EGCDFTSALHSCNNY (SEQ ID NO: 1442) | ISSGLLSGRSDDH (SEQ ID NO: 1095) | | | | |
| RKGCGDFTSASCFVV (SEQ ID NO: 1443) | ISSGLLSGRSDIH (SEQ ID NO: 1096) | | | | |
| GMLCAGSSFGLCESM (SEQ ID NO: 1444) | ISSGLLSGRSDQH (SEQ ID NO: 1097) | | | | |

TABLE 13C-continued

| Mask Sequence | Substrates: | VL SEQ ID NO: | VH SEQ ID NO: | VL CDRs SEQ ID NO: CDR1 | CDR2 | CDR3 | VH CDRs SEQ ID NO: CDR1 | CDR2 | CDR3 |
|---|---|---|---|---|---|---|---|---|---|
| RESCFGSSLGLCTNK (SEQ ID NO: 1445) | ISSGLLSGRSDTH (SEQ ID NO: 1098) | | | | | | | | |
| ILRCYDIPTNCMNFN (SEQ ID NO: 1446) | ISSGLLSGRSDYH (SEQ ID NO: 1099) | | | | | | | | |
| NSECTFGAMYCRNKP (SEQ ID NO: 1447) | ISSGLLSGRSDNP (SEQ ID NO: 1100) | | | | | | | | |
| ASGCFDEDIRCSGGA (SEQ ID NO: 1448) | ISSGLLSGRSANP (SEQ ID NO: 1101) | | | | | | | | |
| HYFCNQSNPSCQTAP (SEQ ID NO: 1449) | ISSGLLSGRSANI (SEQ ID NO: 1102) | | | | | | | | |
| AMGCELGGAGCIGSP (SEQ ID NO: 1450) | AVGLLAPPGGLSGRSDDH (SEQ ID NO: 1103) | | | | | | | | |
| TLKCHMPRKLCANDP (SEQ ID NO: 1451) | AVGLLAPPGGLSGRSDIH (SEQ ID NO: 1104) | | | | | | | | |
| RPACRDLPHNCITST (SEQ ID NO: 1452) | AVGLLAPPGGLSGRSDQH (SEQ ID NO: 1105) | | | | | | | | |
| QMSCHGNFTTCHSNP (SEQ ID NO: 1453) | AVGLLAPPGGLSGRSDTH (SEQ ID NO: 1106) | | | | | | | | |
| LTGCARGARPCRLRV (SEQ ID NO: 1454) | AVGLLAPPGGLSGRSDYH (SEQ ID NO: 1107) | | | | | | | | |
| WSELCLAGPSCGWVG (SEQ ID NO: 1455) | AVGLLAPPGGLSGRSDNP (SEQ ID NO: 1108) | | | | | | | | |
| VTKSCWQLPHCITAP (SEQ ID NO: 1456) | AVGLLAPPGGLSGRSANP (SEQ ID NO: 1109) | | | | | | | | |
| KAASCPHNQICNMTA (SEQ ID NO: 1457) | AVGLLAPPGGLSGRSANI (SEQ ID NO: 1110) | | | | | | | | |
| VSKNCFSGMMCPVFA (SEQ ID NO: 1458) | ISSGLLSGRSDNI (SEQ ID NO: 1111) | | | | | | | | |
| NRSSCWTGPTCHVLH (SEQ ID NO: 1459) | AVGLLAPPGGLSGRSDNI (SEQ ID NO: 1112) | | | | | | | | |
| ARTGCSGPVCLNDVS (SEQ ID NO: 1460) | | | | | | | | | |
| STRTCLAFTCINGNT (SEQ ID NO: 1461) | | | | | | | | | |
| MLDGNCWYACSYKNT (SEQ ID NO: 1462) | | | | | | | | | |
| FSRSDCWSACAPWRV (SEQ ID NO: 1463) | | | | | | | | | |
| GGRMDCWASCQPLSR (SEQ ID NO: 1464) | | | | | | | | | |
| NSPHSCMTNCDFTSA (SEQ ID NO: 1465) | | | | | | | | | |

TABLE 13D

| Mask Sequence | Substrates: | LC SEQ ID NO: | HC SEQ ID NO: | LC CDRs SEQ ID NO: CDR1 CDR2 CDR3 | HC CDRs SEQ ID NO: CDR1 CDR2 CDR3 |
|---|---|---|---|---|---|
| DYTYCRWVNWCLSGV (SEQ ID NO: 384) | LSGRSDNH (SEQ ID NO: 294) | 543 | 546 | LC CDRs of SEQ ID NO: 543 | HC CDRs of SEQ ID NO: 546 |
| ILCPEDPWGHKCKLP (SEQ ID NO: 385) | TGRGPSWV (SEQ ID NO: 295) | | | | |
| TNIWSCQTYCDHKHK (SEQ ID NO: 386) | PLTGRSGG (SEQ ID NO: 296) | | | | |
| SDHKCKLQNCMNTKV (SEQ ID NO: 387) | TARGPSFK (SEQ ID NO: 297) | | | | |
| PGNCHPMQKEMCQFI (SEQ ID NO: 388) | NTLSGRSENHSG (SEQ ID NO: 298) | | | | |
| VEHLCYTHNKCKHPD (SEQ ID NO: 389) | NTLSGRSGNHGS (SEQ ID NO: 299) | | | | |
| TIPRCGQHPKCKDTL (SEQ ID NO: 390) | TSTSGRSANPRG (SEQ ID NO: 300) | | | | |
| ACRICQDHPKTKWNS (SEQ ID NO: 391) | TSGRSANP (SEQ ID NO: 301) | | | | |
| LIQCTGNLDHKCKHY (SEQ ID NO: 392) | VHMPLGFLGP (SEQ ID NO: 302) | | | | |
| IPCHHSADHKHKCTS (SEQ ID NO: 393) | AVGLLAPP (SEQ ID NO: 303) | | | | |
| SRQICADYNCHNKYK (SEQ ID NO: 394) | AQNLLGMV (SEQ ID NO: 304) | | | | |
| QPCNPQIDHKIKCIY (SEQ ID NO: 395) | QNQALRMA (SEQ ID NO: 305) | | | | |
| HYTICMTHNKCKDMA (SEQ ID NO: 396) | LAAPLGLL (SEQ ID NO: 306) | | | | |
| ANSCLAVEHKCKHNY (SEQ ID NO: 397) | STFPFGMF (SEQ ID NO: 307) | | | | |
| AALHCTEHKCKNHIK (SEQ ID NO: 398) | ISSGLLSS (SEQ ID NO: 308) | | | | |
| APCIINTVDWKSCEI (SEQ ID NO: 399) | PAGLWLDP (SEQ ID NO: 309) | | | | |
| ATNWCTHKQKCKQDM (SEQ ID NO: 400) | VAGRSMRP (SEQ ID NO: 310) | | | | |
| DCYNEHKLKTRVCNN (SEQ ID NO: 401) | VVPEGRRS (SEQ ID NO: 311) | | | | |
| DEMQCSHKQKCTNSK (SEQ ID NO: 402) | ILPRSPAF (SEQ ID NO: 312) | | | | |
| DVGICSQHNKCKPTK (SEQ ID NO: 403) | MVLGRSLL (SEQ ID NO: 313) | | | | |
| EKYCSSDDHKCKITL (SEQ ID NO: 404) | QGRAITFI (SEQ ID NO: 314) | | | | |
| ELECSHNKVKNCIQI (SEQ ID NO: 405) | SPRSIMLA (SEQ ID NO: 315) | | | | |
| ELHPCNTHKCKPIVN (SEQ ID NO: 406) | SMLRSMPL (SEQ ID NO: 316) | | | | |
| EVGSCNHPKCKSNNY (SEQ ID NO: 407) | SARGPSRW (SEQ ID NO: 319) | | | | |
| EYSPSLAHPKLKDNA (SEQ ID NO: 408) | GWHTGRN (SEQ ID NO: 320) | | | | |

TABLE 13D-continued

| Mask Sequence | Substrates: | LC SEQ ID NO: | HC SEQ ID NO: | LC CDRs SEQ ID NO: CDR1 CDR2 CDR3 | HC CDRs SEQ ID NO: CDR1 CDR2 CDR3 |
|---|---|---|---|---|---|
| FESLHPKGKHPEDLG (SEQ ID NO: 409) | HTGRSGAL (SEQ ID NO: 321) | | | | |
| FPLCVRADRVCGDAQ (SEQ ID NO: 410) | AARGPAIH (SEQ ID NO: 322) | | | | |
| FQAPPASHNKLKPSL (SEQ ID NO: 411) | RGPAFNPM (SEQ ID NO: 323) | | | | |
| GAIDSCHHKCKSPHY (SEQ ID NO: 412) | SSRGPAYL (SEQ ID NO: 324) | | | | |
| GKIYTCEHNCTFGYS (SEQ ID NO: 413) | RGPATPIM (SEQ ID NO: 325) | | | | |
| HCTVNNHSSDHKCKI (SEQ ID NO: 414) | RGPA (SEQ ID NO: 326) | | | | |
| HGTQCTHNKCKPILS (SEQ ID NO: 415) | GGQPSGMWGW (SEQ ID NO: 327) | | | | |
| HIGWCLHPKCKTTTT (SEQ ID NO: 416) | FPRPLGITGL (SEQ ID NO: 328) | | | | |
| HLRTCIQKWCEHKMK (SEQ ID NO: 417) | SPLTGRSG (SEQ ID NO: 329) | | | | |
| HTDCTMMSNHKCKIN (SEQ ID NO: 418) | SAGFSLPA (SEQ ID NO: 330) | | | | |
| IRQQCTALACLLKVH (SEQ ID NO: 419) | LAPLGLQRR (SEQ ID NO: 331) | | | | |
| KGCSTHKMRAYCNQM (SEQ ID NO: 420) | SGGPLGVR (SEQ ID NO: 332) | | | | |
| KMFTPCKIWCNNSYN (SEQ ID NO: 421) | PLGL (SEQ ID NO: 333) | | | | |
| KTMCSGHKQKCNNSS (SEQ ID NO: 422) | ISSGLSS (SEQ ID NO: 334) | | | | |
| LACHSASLVDHKCKL (SEQ ID NO: 423) | PVGYTSSL (SEQ ID NO: 335) | | | | |
| LCNVSMDHKHKPCYL (SEQ ID NO: 424) | DWLYWPGI (SEQ ID NO: 336) | | | | |
| LGLNCFSEHKCKEHM (SEQ ID NO: 425) | LKAAPRWA (SEQ ID NO: 337) | | | | |
| LGTCTHKHKNCNYTL (SEQ ID NO: 426) | GPSHLVLT (SEQ ID NO: 338) | | | | |
| LHEGCTTHNKCKPIA (SEQ ID NO: 427) | LPGGLSPW (SEQ ID NO: 339) | | | | |
| LKRSCTGHWTCYTNW (SEQ ID NO: 428) | MGLFSEAG (SEQ ID NO: 340) | | | | |
| LQRCTHKEKYCHAIH (SEQ ID NO: 429) | SPLPLRVP (SEQ ID NO: 341) | | | | |
| LSHCYDHKRKCSYIV (SEQ ID NO: 430) | RMHLRSLG (SEQ ID NO: 342) | | | | |
| LSKCHNKEKNCSNNN (SEQ ID NO: 431) | LLAPSHRA (SEQ ID NO: 343) | | | | |
| MDTCEMHKQKCRPSF (SEQ ID NO: 432) | GPRSFGL (SEQ ID NO: 344) | | | | |
| MHNECLTHKCKVPIT (SEQ ID NO: 433) | GPRSFG (SEQ ID NO: 345) | | | | |

TABLE 13D-continued

|  |  | LC | HC | LC CDRs SEQ ID NO: | | | HC CDRs SEQ ID NO: | | |
|---|---|---|---|---|---|---|---|---|---|
| Mask Sequence | Substrates: | SEQ ID NO: | SEQ ID NO: | CDR1 | CDR2 | CDR3 | CDR1 | CDR2 | CDR3 |
| MLTLCNTNACHKEKN (SEQ ID NO: 434) | LSGRSGNH (SEQ ID NO: 1157) | | | | | | | | |
| MRPCLNNLEHKCKHY (SEQ ID NO: 435) | SGRSANPRG (SEQ ID NO: 1158) | | | | | | | | |
| MSRCPTHKMKCSLNI (SEQ ID NO: 436) | LSGRSDDH (SEQ ID NO: 1161) | | | | | | | | |
| MWICQEHKLKCMTDT (SEQ ID NO: 437) | LSGRSDIH (SEQ ID NO: 1162) | | | | | | | | |
| MYYCKRRSAFYCTLN (SEQ ID NO: 438) | LSGRSDQH (SEQ ID NO: 1165) | | | | | | | | |
| NDCQHDKQMHKCKMH (SEQ ID NO: 439) | LSGRSDTH (SEQ ID NO: 1166) | | | | | | | | |
| NFGPCPMLLGCFGFR (SEQ ID NO: 440) | LSGRSDYH (SEQ ID NO: 1169) | | | | | | | | |
| NHTDCSHPKCKSHDS (SEQ ID NO: 441) | LSGRSDNP (SEQ ID NO: 1520) | | | | | | | | |
| NLNCPHKQKNCDKYH (SEQ ID NO: 442) | LSGRSANP (SEQ ID NO: 1695) | | | | | | | | |
| NPQCTPIDHKCKTHH (SEQ ID NO: 443) | LSGRSANI (SEQ ID NO: 1696) | | | | | | | | |
| NTTSCTHPKCKHQGK (SEQ ID NO: 444) | LSGRSDNI (SEQ ID NO: 1697) | | | | | | | | |
| NVGGCDNYGCHKLKN (SEQ ID NO: 445) | MIAPVAYR (SEQ ID NO: 1698) | | | | | | | | |
| PCSPGNLTWDHKCKY (SEQ ID NO: 446) | RPSPMWAY (SEQ ID NO: 1699) | | | | | | | | |
| PFTKCHGFNKCKEHT (SEQ ID NO: 447) | WATPRPMR (SEQ ID NO: 1700) | | | | | | | | |
| PGDKCTHKEKCYYNN (SEQ ID NO: 448) | FRLLDWQW (SEQ ID NO: 1701) | | | | | | | | |
| PNICNLDHKRKCRIN (SEQ ID NO: 449) | ISSGL (SEQ ID NO: 1702) | | | | | | | | |
| PQLACKHPKCKDAGN (SEQ ID NO: 450) | ISSGLLS (SEQ ID NO: 1703) | | | | | | | | |
| PSCTMWTHGGVCKHA (SEQ ID NO: 451) | ISSGLL (SEQ ID NO: 1704) | | | | | | | | |
| PSHRHPLAKPGFRVE (SEQ ID NO: 452) | ISSGLLSGRSDNH (SEQ ID NO: 214) | | | | | | | | |
| PTCFKTHNKSKCNRV (SEQ ID NO: 453) | AVGLLAPPGGLSGRSDNH (SEQ ID NO: 318) | | | | | | | | |
| PTPVCHHNFHCFGYD (SEQ ID NO: 454) | ISSGLLSSGGSGGSLSGRSDNH (SEQ ID NO: 346) | | | | | | | | |
| QATCQWKKRSKCHNK (SEQ ID NO: 455) | ISSGLLSSGGSGGSLSGRSDNH (SEQ ID NO: 346) | | | | | | | | |
| QHSWCQHKAKCNYGN (SEQ ID NO: 456) | AVGLLAPPGGTSTSGRSANPRG (SEQ ID NO: 347) | | | | | | | | |
| QNCSPTYTTHKCKLT (SEQ ID NO: 457) | TSTSGRSANPRGGGAVGLLAPP (SEQ ID NO: 348) | | | | | | | | |
| QSSNCEHKRKCSSIS (SEQ ID NO: 458) | VHMPLGFLGPGGTSTSGRSANPRG (SEQ ID NO: 349) | | | | | | | | |

TABLE 13D-continued

| Mask Sequence | Substrates: | LC SEQ ID NO: | HC SEQ ID NO: | LC CDRs SEQ ID NO: CDR1 CDR2 CDR3 | HC CDRs SEQ ID NO: CDR1 CDR2 CDR3 |
|---|---|---|---|---|---|
| RPCLLGLVPDHKCKL (SEQ ID NO: 459) | TSTSGRSANPRGGGVHMPLGFLGP (SEQ ID NO: 350) | | | | |
| RRSCMRSINTCKQKY (SEQ ID NO: 460) | LSGRSDNHGGAVGLLAPP (SEQ ID NO: 351) | | | | |
| RSSCPTVTPQNCENQ (SEQ ID NO: 461) | VHMPLGFLGPGGLSGRSDNH (SEQ ID NO: 352) | | | | |
| RTMCLDLNHKCKPSN (SEQ ID NO: 462) | LSGRSDNHGGVHMPLGFLGP (SEQ ID NO: 353) | | | | |
| RTYWCTNHNKCKHNM (SEQ ID NO: 463) | LSGRSDNHGGSGGSISSGLLSS (SEQ ID NO: 354) | | | | |
| RVENCEHNQYCHKWK (SEQ ID NO: 464) | LSGRSGNHGGSGGSISSGLLSS (SEQ ID NO: 355) | | | | |
| SCHEDDHKNKNICSL (SEQ ID NO: 465) | ISSGLLSSGGSGGSLSGRSGNH (SEQ ID NO: 356) | | | | |
| SDTCVMNHPKCKRDN (SEQ ID NO: 466) | LSGRSDNHGGSGGSQNQALRMA (SEQ ID NO: 357) | | | | |
| SSTCFHPNQKECMTK (SEQ ID NO: 467) | QNQALRMAGGSGGSLSGRSDNH (SEQ ID NO: 358) | | | | |
| SSYCGGITMRCRRAM (SEQ ID NO: 468) | LSGRSGNHGGSGGSQNQALRMA (SEQ ID NO: 359) | | | | |
| STGYCTYVNWCNYTN (SEQ ID NO: 469) | QNQALRMAGGSGGSLSGRSGNH (SEQ ID NO: 360) | | | | |
| THKCKLHLQVCTQTT (SEQ ID NO: 470) | ISSGLLSGRSGNH (SEQ ID NO: 361) | | | | |
| TMNCTHPKQKCQHTN (SEQ ID NO: 471) | ISSGLLSSGGSGGSLSGRNH (SEQ ID NO: 1091) | | | | |
| TNVLCESHNCDHKNK (SEQ ID NO: 472) | ISSGLLSGRSANPRG (SEQ ID NO: 1092) | | | | |
| TQHAASLGVEHKSKI (SEQ ID NO: 473) | AVGLLAPPTSGRSANPRG (SEQ ID NO: 1093) | | | | |
| TQLPCFDDHKCKNTN (SEQ ID NO: 474) | AVGLLAPPSGRSANPRG (SEQ ID NO: 1094) | | | | |
| TSDSCMRQKCEHKEK (SEQ ID NO: 475) | ISSGLLSGRSDDH (SEQ ID NO: 1095) | | | | |
| TTCDDHKYKHKCAQL (SEQ ID NO: 476) | ISSGLLSGRSDIH (SEQ ID NO: 1096) | | | | |
| TTCGAHKEKQHCIYT (SEQ ID NO: 477) | ISSGLLSGRSDQH (SEQ ID NO: 1097) | | | | |
| TTYCAYWHNKCKFET (SEQ ID NO: 478) | ISSGLLSGRSDTH (SEQ ID NO: 1098) | | | | |
| VGPTCGHAKCKQSEV (SEQ ID NO: 479) | ISSGLLSGRSDYH (SEQ ID NO: 1099) | | | | |
| VSHPCNTHKCKTNIV (SEQ ID NO: 480) | ISSGLLSGRSDNP (SEQ ID NO: 1100) | | | | |
| WDCRNTSHPKLKCHN (SEQ ID NO: 481) | ISSGLLSGRSANP (SEQ ID NO: 1101) | | | | |
| WSPCNSDHKRKCNNG (SEQ ID NO: 482) | ISSGLLSGRSANI (SEQ ID NO: 1102) | | | | |
| YANMSCEYDCHKMKY (SEQ ID NO: 483) | AVGLLAPPGGLSGRSDDH (SEQ ID NO: 1103) | | | | |

TABLE 13D-continued

| Mask Sequence | Substrates: | LC SEQ ID NO: | HC SEQ ID NO: | LC CDRs SEQ ID NO: CDR1 CDR2 CDR3 | HC CDRs SEQ ID NO: CDR1 CDR2 CDR3 |
|---|---|---|---|---|---|
| YANPCTHKEKCHFKN (SEQ ID NO: 484) | AVGLLAPPGGLSGRSDIH (SEQ ID NO: 1104) | | | | |
| YDCSPSWTHPKCKHK (SEQ ID NO: 485) | AVGLLAPPGGLSGRSDQH (SEQ ID NO: 1105) | | | | |
| YGWTCTTHPKCKTTN (SEQ ID NO: 486) | AVGLLAPPGGLSGRSDTH (SEQ ID NO: 1106) | | | | |
| YQKCHPKAKDCGNNT (SEQ ID NO: 487) | AVGLLAPPGGLSGRSDYH (SEQ ID NO: 1107) | | | | |
| YWECPNMEHNKCKNN (SEQ ID NO: 488) | AVGLLAPPGGLSGRSDNP (SEQ ID NO: 1108) | | | | |
| PMGNRYCVLDHPKLK (SEQ ID NO: 489) | AVGLLAPPGGLSGRSANP (SEQ ID NO: 1109) | | | | |
| GHKSCCQKHCEYTQT (SEQ ID NO: 490) | AVGLLAPPGGLSGRSANI (SEQ ID NO: 1110) | | | | |
| LYLEMCSCCCWESIT (SEQ ID NO: 491) | ISSGLLSGRSDNI (SEQ ID NO: 1111) | | | | |
| ACQAQHCYKTYACKP (SEQ ID NO: 492) | AVGLLAPPGGLSGRSDNI (SEQ ID NO: 1112) | | | | |
| CCYTCSVHPKCKNQL (SEQ ID NO: 493) | | | | | |
| CKHRCSHKEKCPANH (SEQ ID NO: 494) | | | | | |
| CHVLFCLMQCCRWSL (SEQ ID NO: 495) | | | | | |
| LNSSLVFDHPKAKPN (SEQ ID NO: 496) | | | | | |
| MCLLCRSKFGCKVKG (SEQ ID NO: 497) | | | | | |
| IICNDHKCKQNQCNN (SEQ ID NO: 498) | | | | | |
| IRCSLRDSLCGCERM (SEQ ID NO: 499) | | | | | |
| TSCQPPKHKCTCNHG (SEQ ID NO: 500) | | | | | |
| TQCPHRCVKPNCWLH (SEQ ID NO: 501) | | | | | |
| KCCETKRNHKHCTYK (SEQ ID NO: 502) | | | | | |
| LPHCCHKAKHCNHTS (SEQ ID NO: 503) | | | | | |
| PAMCAAIHEKCCIKV (SEQ ID NO: 504) | | | | | |
| PRSCGNQLCPCHYYK (SEQ ID NO: 505) | | | | | |
| TNKCSCNHNMKCINY (SEQ ID NO: 506) | | | | | |
| VETCCQHNKCKYPFI (SEQ ID NO: 507) | | | | | |
| IFCCSNHEDHKCKTN (SEQ ID NO: 508) | | | | | |

TABLE 13D-continued

| Mask Sequence | Substrates: | LC SEQ ID NO: | HC SEQ ID NO: | LC CDRs SEQ ID NO: CDR1 CDR2 CDR3 | HC CDRs SEQ ID NO: CDR1 CDR2 CDR3 |
|---|---|---|---|---|---|
| VCRLICPLTCVIGVG (SEQ ID NO: 509) | | | | | |
| FHGCCSVYSCLTNPG (SEQ ID NO: 510) | | | | | |
| ALACHPKQKPLEGQL (SEQ ID NO: 511) | | | | | |
| SIICCATSSCPLKHL (SEQ ID NO: 512) | | | | | |
| APCCRPHKEKPIDSR (SEQ ID NO: 513) | | | | | |
| WELCCPSADCRVAMG (SEQ ID NO: 514) | | | | | |
| QDHPKTKWNS (SEQ ID NO: 548) | | | | | |
| ACRICQDHPATKWNS (SEQ ID NO: 549) | | | | | |
| ACRICQDHPKTAWNS (SEQ ID NO: 550) | | | | | |
| ACRICQDAPKTKWNS (SEQ ID NO: 551) | | | | | |
| ACRICQDHAKTKWNS (SEQ ID NO: 552) | | | | | |
| DHPATKWNS (SEQ ID NO: 553) | | | | | |
| DHPKTAWNS (SEQ ID NO: 554) | | | | | |
| DAPKTKWNS (SEQ ID NO: 555) | | | | | |
| DAPATKWNS (SEQ ID NO: 556) | | | | | |
| ACRICQDHP (SEQ ID NO: 557) | | | | | |
| HPQSKDTL (SEQ ID NO: 558) | | | | | |
| HPKSQDTL (SEQ ID NO: 559) | | | | | |
| TIPRCGQHPLCLDTL (SEQ ID NO: 560) | | | | | |
| HPLSLDTL (SEQ ID NO: 561) | | | | | |
| HPASKDTL (SEQ ID NO: 562) | | | | | |
| HPKSADTL (SEQ ID NO: 563) | | | | | |
| PGNCHPLQKELCQFI (SEQ ID NO: 564) | | | | | |
| HPLQKELAQFI (SEQ ID NO: 565) | | | | | |
| HPLALELAQFI (SEQ ID NO: 566) | | | | | |

TABLE 13D-continued

| Mask Sequence | Substrates: | LC SEQ ID NO: | HC SEQ ID NO: | LC CDRs SEQ ID NO: CDR1 CDR2 CDR3 | HC CDRs SEQ ID NO: CDR1 CDR2 CDR3 |
|---|---|---|---|---|---|
| PGNCHPLQLELCQFI (SEQ ID NO: 567) | | | | | |
| TNIWSCQTYCDHAHA (SEQ ID NO: 568) | | | | | |
| TNIWSCQTYCDHAHL (SEQ ID NO: 569) | | | | | |
| TNIWSCQTYCDHLHA (SEQ ID NO: 570) | | | | | |
| TNIWSCQTYCDHKHA (SEQ ID NO: 571) | | | | | |

Any of the combinations described in Tables 13A, 13B, 13C, and/or 13D can be combined with human immunoglobulin constant regions to result in fully humanized IgGs including IgG1, IgG2, IgG4 or mutated constant regions to result in human IgGs with altered functions such as IgG1 N297A, IgG1 N297Q, or IgG4 S228P. Additional examples are known to those skilled in the art. Examples of Ig heavy chain constant region amino acids in which mutations in at least one amino acid leads to reduced Fc function include, but are not limited to, mutations in amino acid 228, 233, 234, 235, 236, 237, 239, 252, 254, 256, 265, 270, 297, 318, 320, 322, 327, 329, 330, and 331 of the heavy constant region. Examples of combinations of mutated amino acids are also known in the art, such as, but not limited to a combination of mutations in amino acids 234, 235, and 331, such as L234F, L235E, and P331S or a combination of amino acids 318, 320, and 322, such as E318A, K320A, and K322A.

As an example a masking moiety comprising SEQ ID NO: 66 can be combined with a substrate comprising SEQ ID NO: 294, and a VL region comprising SEQ ID NO: 39 in combination with a human kappa constant domain comprising SEQ ID NO: 61 to produce a light chain, which may or may not include linker regions. One such example is SEQ ID NO: 380, although other embodiments having longer linker sequences are also contemplated. In some embodiments, for example, a VH region comprising SEQ ID NO: 21 can be combined a with human immunoglobulin heavy chain constant domain to give an IgG1 heavy chain (SEQ ID NO: 2048), an IgG4 heavy chain (SEQ ID NO: 2051), an IgG4 S228P heavy chain (SEQ ID NO: 2047), a mutated IgG1 N297A heavy chain (SEQ ID NO: 2049) or a mutated IgG1 N297Q heavy chain (SEQ ID NO: 2050). Co-expression of SEQ ID NO: 380 with SEQ ID NO: 2048 will yield an IgG1 anti-PD-1 activatable antibody. Co-expression of SEQ ID NO: 380 with SEQ ID NO: 2051 will yield an IgG4 anti-PD-1 activatable antibody. Co-expression of SEQ ID NO: 380 with SEQ ID NO: 2047 will yield an IgG4S228P anti-PD-1 activatable antibody. Co-expression of SEQ ID NO: 380 with SEQ ID NO: 2049 will yield an IgG1 N297A anti-PD-1 activatable antibody. Co-expression of SEQ ID NO: 380 with SEQ ID NO: 2050 will yield an IgG1 N297Q anti-PD-1 activatable antibody.

In some embodiments, a masking moiety comprising SEQ ID NO: 99 is combined with a substrate comprising SEQ ID NO: 214 and a VL region comprising SEQ ID NO: 47 in combination with a human kappa constant domain comprising SEQ ID NO: 61 to produce a light chain comprising SEQ ID NO: 2055. In some embodiments, spacer QGQSGQG (SEQ ID NO: 362) is added to the N-terminus of SEQ ID NO: 2055 to form SEQ ID NO: 2054. In some embodiments, a masking moiety comprising SEQ ID NO: 99 is combined with a substrate comprising SEQ ID NO: 1100 and a VL region comprising SEQ ID NO: 47 in combination with a human kappa constant domain comprising SEQ ID NO: 61 to produce a light chain comprising SEQ ID NO: 2057. In some embodiments, spacer QGQSGQG (SEQ ID NO: 362) is added to the N-terminus of SEQ ID NO: 2057 to form SEQ ID NO: 2056. In some embodiments, a masking moiety comprising SEQ ID NO: 99 is combined with a substrate comprising SEQ ID NO: 1101, and a VL region comprising SEQ ID NO: 47 in combination with a human kappa constant domain comprising SEQ ID NO: 61 to produce a light chain comprising SEQ ID NO: 2059. In some embodiments, spacer QGQSGQG (SEQ ID NO: 362) is added to the N-terminus of SEQ ID NO: 2059 to form SEQ ID NO: 2058. In some embodiments, a VH region comprising SEQ ID NO: 21 can be combined with an IgG4 S228P human immunoglobulin heavy chain constant domain comprising SEQ ID NO: 63 to produce a heavy chain comprising SEQ ID NO: 2052. In some embodiments, the C-terminal lysine of SEQ ID NO: 2052 is missing to form an amino acid sequence having SEQ ID NO: 2053. Co-expression of any one of these light chains with any one of these heavy chains will lead to production of an activatable antibody of the embodiments.

Constant region amino acid sequences are shown below in SEQ ID NO: 381, 382, 383, and 1807.

IgG1 Hc CH1-End Amino Acid Sequence:

(SEQ ID NO: 381)
ASTKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKKVEPKSCDKTHTCPPCPAPELLGGPSVFLFPP

KPKDTLMISRTPEVTCVVVDVSHEDPEVKFNWYVDGVEVHNAKTKPREEQY☐STYRVVSVLTVL

HQDWLNGKEYKCKVSNKALPAPIEKTISKAKGQPREPQVYTLPPSREEMTKNQVSLTCLVKGFY

PSDIAVEWESNGQPENNYKTTPPVLDSDGSFFLYSKLTVDKSRWQQGNVFSCSVMHEALHNHYT

QKSLSLSPG

IgG1NA CH1-End Amino Acid Sequence:

(SEQ ID NO: 382)
ASTKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKKVEPKSCDKTHTCPPCPAPELLGGPSVFLFPP

KPKDTLMISRTPEVTCVVVDVSHEDPEVKFNWYVDGVEVHNAKTKPREEQYASTYRVVSVLTVL

HQDWLNGKEYKCKVSNKALPAPIEKTISKAKGQPREPQVYTLPPSREEMTKNQVSLTCLVKGFY

PSDIAVEWESNGQPENNYKTTPPVLDSDGSFFLYSKLTVDKSRWQQGNVFSCSVMHEALHNHYT

QKSLSLSPG

IgG1NQ CH1-End Amino Acid Sequence:

(SEQ ID NO: 1807)
ASTKGPSVFPLAPSSKSTSGGTAALGCLVKDYFPEPVTVSWNSGALTSGVHTFPAVLQSSGLYS

LSSVVTVPSSSLGTQTYICNVNHKPSNTKVDKKVEPKSCDKTHTCPPCPAPELLGGPSVFLFPP

KPKDTLMISRTPEVTCVVVDVSHEDPEVKFNWYVDGVEVHNAKTKPREEQYQSTYRVVSVLTVL

HQDWLNGKEYKCKVSNKALPAPIEKTISKAKGQPREPQVYTLPPSREEMTKNQVSLTCLVKGFY

PSDIAVEWESNGQPENNYKTTPPVLDSDGSFFLYSKLTVDKSRWQQGNVFSCSVMHEALHNHYT

QKSLSLSPG

IgG4 Hc CH1-End Amino Acid Sequence:

(SEQ ID NO: 383)
ASTKGPSVFPLAPCSRSTSESTAALGCLVKDYFPEPVTVSWNSGALTSGVHTFPAVLQSSGLYS

LSSVVTVPSSSLGTKTYTCNVDHKPSNTKVDKRVESKYGPPCPPCPAPEFLGGPSVFLFPPKPK

DTLMISRTPEVTCVVVDVSQEDPEVQFNWYVDGVEVHNAKTKPREEQFNSTYRVVSVLTVLHQD

WLNGKEYKCKVSNKGLPSSIEKTISKAKGQPREPQVYTLPPSQEEMTKNQVSLTCLVKGFYPSD

IAVEWESNGQPENNYKTTPPVLDSDGSFFLYSRLTVDKSRWQEGNVFSCSVMHEALHNHYTQKS

LSLSLG

Light Chain (Lc) Amino Acid Sequence:

AMSGCSWSAFCPYLA[X1]$_n$LSGRSDNH[X2]$_n$DIQLTQSPSSLSASVGDRV

TITCRASESVDNYGISFMNWFQQKPGKAPKLLIYAASNQGSGVPSRFSGS

GSGTDFTLTISSMQPEDFATYYCQQSKDVPWTFGQGTKLEIKRTVAAPSV

FIFPPSDEQLKSGTASVVCLLNNFYPREAKVQWKVDNALQSGNSQESVTE

QDSKDSTYSLSSTLTLSKADYEKHKVYACEVTHQGLSSPVTKSFNRGEC where each of [X1]$_n$ and [X2]$_n$ independently can be a linking peptide of between 0 and 20 amino acids (SEQ ID NO: 380), or any other suitable length.

IgG4 S228P Heavy Chain (Hc) Amino Acid Sequence:

(SEQ ID NO: 2047)
EVQLVESGGGLVQPGGSLRLSCAAS<u>GFTFSGYAMS</u>WVRQAPGKGLEWVA<u>Y

ISNSGGNAH</u>YADSVKGRFTISRDNSKNTLYLMNSLRAEDTAVYYCTR<u>ED

YGTSPFVY</u>WGQGTLVTVSSASTKGPSVFPLAPCSRSTSESTAALGCLVKD

YFPEPVTVSWNSGALTSGVHTFPAVLQSSGLYSLSSVVTVPSSSLGTKTY

TCNVDHKPSNTKVDKRVESKYGPPCPPCPAPEFLGGPSVFLFPPKPKDTL

MISRTPEVTCVVVDVSQEDPEVQFNWYVDGVEVHNAKTKPREEQFNSTYR

VVSVLTVLHQDWLNGKEYKCKVSNKGLPSSIEKTISKAKGQPREPQVYTL

-continued
PPSQEEMTKNQVSLTCLVKGFYPSDIAVEWESNGQPENNYKTTPPVLDSD
GSFFLYSRLTVDKSRWQEGNVFSCSVMHEALHNHYTQKSLSLSLGK IgG1 Heavy Chain (Hc) Amino Acid Sequence:

(SEQ ID NO: 2048)
EVQLVESGGGLVQPGGSLRLSCAASGFTFSGYAMSWVRQAPGKGLEWVAYISNSGGNAHYADSV
KGRFTISRDNSKNTLYLQMNSLRAEDTAVYYCTREDYGTSPFVYWGQGTLVTVSS
ASTKGPSVFPLAPSSKSTSGGTAALGCLVKDYFPEPVTVSWNSGALTSGVHTFPAVLQSSGLYS
LSSVVTVPSSSLGTQTYICNVNHKPSNTKVDKKVEPKSCDKTHTCPPCPAPELLGGPSVFLFPP
KPKDTLMISRTPEVTCVVVDVSHEDPEVKFNWYVDGVEVHNAKTKPREEQY[N]STYRVVSVLTVL
HQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYT
QKSLSLSPG

IgG1NA Hc Amino Acid Sequence:

(SEQ ID NO: 2049)
EVQLVESGGGLVQPGGSLRLSCAASGFTFSGYAMSWVRQAPGKGLEWVAYISNSGGNAHYADSV
KGRFTISRDNSKNTLYLQMNSLRAEDTAVYYCTREDYGTSPFVYWGQGTLVTVSS
ASTKGPSVFPLAPSSKSTSGGTAALGCLVKDYFPEPVTVSWNSGALTSGVHTFPAVLQSSGLYS
LSSVVTVPSSSLGTQTYICNVNHKPSNTKVDKKVEPKSCDKTHTCPPCPAPELLGGPSVFLFPP
KPKDTLMISRTPEVTCVVVDVSHEDPEVKFNWYVDGVEVHNAKTKPREEQY[A]STYRVVSVLTVL
HQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYT
QKSLSLSPG

IgG1NQ Hc Amino Acid Sequence:

(SEQ ID NO: 2050)
EVQLVESGGGLVQPGGSLRLSCAASGFTFSGYAMSWVRQAPGKGLEWVAYISNSGGNAHYADSV
KGRFTISRDNSKNTLYLQMNSLRAEDTAVYYCTREDYGTSPFVYWGQGTLVTVSS
ASTKGPSVFPLAPSSKSTSGGTAALGCLVKDYFPEPVTVSWNSGALTSGVHTFAVLQSSGLYS
LSSVVTVPSSSLGTQTYICNVNHKPSNTKVDKKVEPKSCDKTHTCPPCPAPAPELLGGPSVFLFPP
KPKDTLMISRTPEVTCVVVDVSHEDPEVKFNWYVDGVEVHNAKTKPREEQY[Q]STYRVVSVLTVL
HQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYT
QKSLSLSPG

IgG4 Hc Amino Acid Sequence:

(SEQ ID NO: 2051)
EVQLVESGGGLVQPGGSLRLSCAASGFTFSGYAMSWVRQAPGKGLEWVAYISNSGGNAHYADSV
KGRFTISRDNSKNTLYLQMNSLRAEDTAVYYCTREDYGTSPFVYWGQGTLVTVSS
ASTKGPSVFPLAPCSRSTSESTAALGCLVKDYFPEPVTVSWNSGALTSGVHTFPAVLQSSGLYS
LSSVVTVPSSSLGTKTYTCNVDHKPSNTKVDKRVESKYGPPCP[S]CPAPEFLGGPSVFLFPPKPK

-continued
```
DTLMISRTPEVTCVVVDVSQEDPEVQFNWYVDGVEVHNAKTKPREEQFNSTYRVVSVLTVLHQD

WLNGKEYKCKVSNKGLPSSIEKTISKAKGQPREPQVYTLPPSQEEMTKNQVSLTCLVKGFYPDS

IAVEWESNGQPENNYKTTPPVLDSDGSFFLYSRLTVDKSRWQEGNVFSCSVMHEALHNHYTQKS

LSLSLG
```

Heavy Chain 1 Amino Acid Sequence (SEQ ID NO: 2052):

```
EVQLVESGGGLVQPGGSLRLSCAASGFTFSGYAMSWVRQAPGKGLEWVAY

ISNSGGNAHYADSVKGRFTISRDNSKNTLYLQMNSLRAEDTAVYYCTRED

YGTSPFVYWGQGTLVTVSSASTKGPSVFPLAPCSRSTSESTAALGCLVKD

YFPEPVTVSWNSGALTSGVHTFPAVLQSSGLYSLSSVVTVPSSSLGTKTY

TCNVDHKPSNTKVDKRVESKYGPPCPPCPAPEFLGGPSVFLFPPKPKDTL

MISRTPEVTCVVVDVSQEDPEVQFNWYVDGVEVHNAKTKPREEQFNSTYR

VVSVLTVLHQDWLNGKEYKCKVSNKGLPSSIEKTISKAKGQPREPQVYTL

PPSQEEMTKNQVSLTCLVKGFYPSDIAVEWESNGQPENNYKTTPPVLDSD

GSFFLYSRLTVDKSRWQEGNVFSCSVMHEALHNHYTQKSLSLSLGK
```

Heavy Chain 2 Amino Acid Sequence (SEQ ID NO: 2053):

```
EVQLVESGGGLVQPGGSLRLSCAASGFTFSGYAMSWVRQAPGKGLEWVAY

ISNSGGNAHYADSVKGRFTISRDNSKNTLYLQMNSLRAEDTAVYYCTRED

YGTSPFVYWGQGTLVTVSSASTKGPSVFPLAPCSRSTSESTAALGCLVKD

YFPEPVTVSWNSGALTSGVHTFPAVLQSSGLYSLSSVVTVPSSSLGTKTY

TCNVDHKPSNTKVDKRVESKYGPPCPPCPAPEFLGGPSVFLFPPKPKDTL

MISRTPEVTCVVVDVSQEDPEVQFNWYVDGVEVHNAKTKPREEQFNSTYR

VVSVLTVLHQDWLNGKEYKCKVSNKGLPSSIEKTISKAKGQPREPQVYTL

PPSQEEMTKNQVSLTCLVKGFYPSDIAVEWESNGQPENNYKTTPPVLDSD

GSFFLYSRLTVDKSRWQEGNVFSCSVMHEALHNHYTQKSLSLSLG
```

Light Chain 1 Amino Acid Sequence with Spacer (SEQ ID NO: 2054):

```
[QGQSGQG][TSYCSIEHYPCNTHHGGGSSGGSISSGLLSGRSDNHGG

GSDIQLTQSPSSLSASVGDRVTITCRASESVDAYGISFMNWFQQKPGKAP

KLLIYAASNQGSGVPSRFSGSGSGTDFTLTISSMQPEDFATYYCQQSKDV

PWTFGQGTKLEIKRTVAAPSVFIFPPSDEQLKSGTASVVCLLNNFYPREA

KVQWKVDNALQSGNSQESVTEQDSKDSTYSLSSTLTLSKADYEKHKVY

ACEVTHQGLSSPVTKSFNRGEC]
```

Light Chain 1 Amino Acid Sequence without Spacer (SEQ ID NO: 2055):

```
TSYCSIEHYPCNTHHGGGSSGGSISSGLLSGRSDNHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

KRTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPVT

KSFNRGEC
```

Light Chain 2 Amino Acid Sequence with Spacer (SEQ ID NO: 2056):

```
[QGQSGQG][TSYCSIEHYPCNTHHGGGSSGGSISSGLLSGRSDNPGG

GSDIQLTQSPSSLSASVGDRVTITCRASESVDAYGISFMNWFQQKPGKAP

KLLIYAASNQGSGVPSRFSGSGSGTDFTLTISSMQPEDFATYYCQQSKDV

PWTFGQGTKLEIKRTVAAPSVFIFPPSDEQLKSGTASVVCLLNNFYPREA

KVQWKVDNALQSGNSQESVTEQDSKDSTYSLSSTLTLSKADYEKHKVY

ACEVTHQGLSSPVTKSFNRGEC]
```

Light Chain 2 Amino Acid Sequence without Spacer (SEQ ID NO: 2057):

```
TSYCSIEHYPCNTHHGGGSSGGSISSGLLSGRSDNPGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

KRTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPVT

KSFNRGEC
```

Light Chain 3 Amino Acid Sequence with Spacer (SEQ ID NO: 2058):

```
[QGQSGQG][TSYCSIEHYPCNTHHGGGSSGGSISSGLLSGRSANPG

GGSDIQLTQSPSSLSASVGDRVTITCRASESVDAYGISFMNWFQQKPGKA

PKLLIYAASNQGSGVPSRFSGSGSGTDFTLTISSMQPEDFATYYCQQSKD

VPWTFGQGTKLEIKRTVAAPSVFIFPPSDEQLKSGTASVVCLLNNFYPRE

AKVQWKVDNALQSGNSQESVTEQDSKDSTYSLSSTLTLSKADYEKHKVYA

CEVTHQGLSSPVTKSFNRGEC]
```

Light Chain 3 Amino Acid Sequence without Spacer (SEQ ID NO: 2059):

```
TSYCSIEHYPCNTHHGGGSSGGSISSGLLSGRSANPGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

KRTVAAPSVFIFPPSDEQLKSGTASVVCLLNNFYPREAKVQWKVDNALQS

GNSQESVTEQDSKDSTYSLSSTLTLSKADYEKHKVYACEVTHQGLSSPVT

KSFNRGEC
```

Example 10: Evaluation of Efficiency of Masking Moieties

This example describes activatable anti-PD-1 antibodies of the disclosure with reduced binding to hPD-1.

Masking the ability of an antibody to bind to its antigen is an example of inhibition of binding. The extent of inhibition is dependent on the affinity of the antibody for its antigen, the affinity of the masking moiety (also referred to herein as the mask) for the antibody and the concentration of all reactants. Local concentrations of the tethered peptide mask (inhibitor) is very high in the activatable antibody context, on the order of 10 mM, therefore moderate affinity peptides would effectively mask activatable antibody antigen binding.

Masking efficiencies were evaluated by standard plate ELISA. Briefly, human PD-1-Fc (R and D systems, Minneapolis, Minn.) was adsorbed to the wells of a 96-well ELISA plate. Purified anti-PD-1 antibodies and activatable antibodies were applied to the plate in serial dilution and allowed to bind. Bound antibody and activatable antibodies were detected with anti-human IgG-HRP conjugate, FAb-specific (Sigma, St Louis, Mo.) and visualized with the chromogenic substrate TMB (Thermo Scientific, Rockford, Ill.). Shown are plots of binding isotherms for anti-PD-1 A1.4 and anti-PD-1 A1.5 activatable antibodies (FIGS. 14-18). Plots were generated in Prizm (Sigma Plot); the data were fit to a model of single site saturation binding, and the equilibrium dissociation constant, $K_d$, was determined. Masking efficiency was calculated by dividing the $K_d$ for binding of the activatable antibodies by the $K_d$ of the parental antibody. The masking efficiency (ME) values for the tested antibodies are shown in Table 14 and Table 15 below (masking moiety PD001 is also referred to herein as PD01 and/or PD-01; masking moiety PD002 is also referred to herein as PD02 and/or PD-02, and so on), and the apparent $K_d$ (nM) and masking efficiency (ME) values for the tested activatable antibodies are shown in Table 26:

TABLE 14

Figure 14:
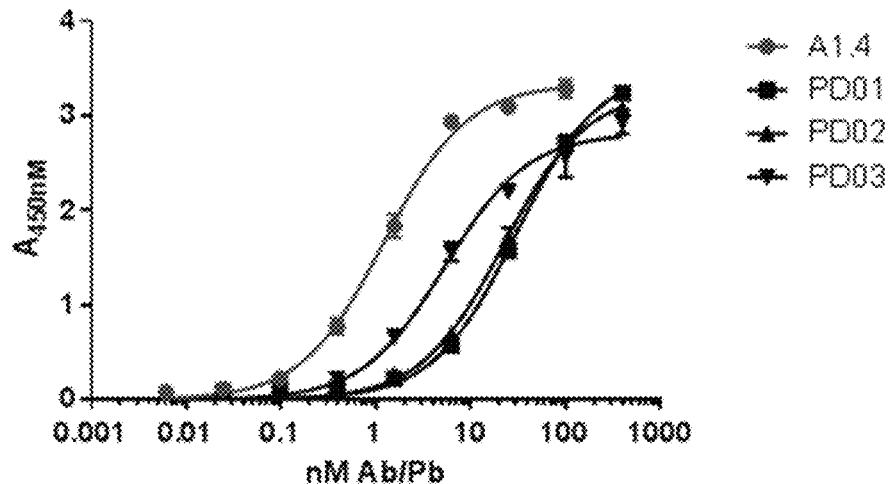
FIG. 14 is a series of graphs depicting the binding to human PD-1 by anti-PD-1 antibody A1.4 and by various activatable anti-PD-1 antibodies that include the various masking moieties referred to herein as PD01 (SEQ ID NO: 66), PD02 (SEQ ID NO: 67), PD03 (SEQ ID NO: 68), PD08 (SEQ ID NO: 73), PD09 (SEQ ID NO: 74), and PD10 (SEQ ID NO: 75) as determined by ELISA.
Figure 14:
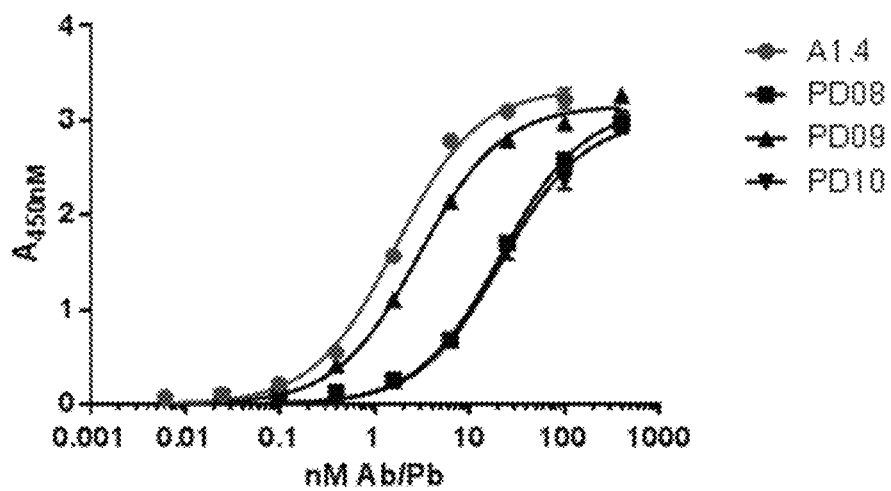

Masking efficiency values for activatable antibodies tested in FIG. 14

| Mask | ME |
|---|---|
| PD01 | 25 |
| PD02 | 18 |
| PD03 | 5 |
| PD08 | 13 |
| PD09 | 2 |
| PD-10 | 13 |

TABLE 15

Figure 18:
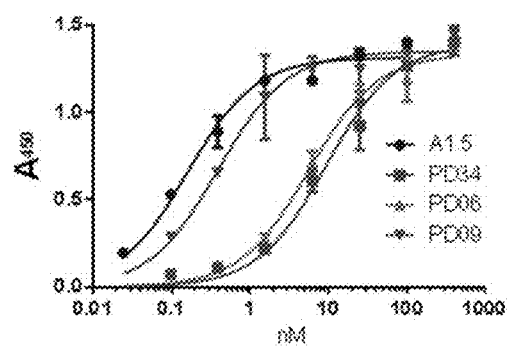
FIG. 18 is a series of graphs depicting the binding to hPD-1 by the anti-PD-1 antibody A1.5 and by various activatable anti-PD-1 antibodies that include the anti-PD-1 antibody A1.5 and the masking moieties referred to herein as PD34 (SEQ ID NO: 99), PD06 (SEQ ID NO: 71), PD09 (SEQ ID NO: 74) (upper left panel); PD34 (SEQ ID NO: 99), PD12 (SEQ ID NO: 77), PD17 (SEQ ID NO: 82) (upper right panel); PD34 (SEQ ID NO: 99), PD19 (SEQ ID NO: 84), PD25 (SEQ ID NO: 90) (lower left panel); and PD34 (SEQ ID NO: 99), PD26 (SEQ ID NO: 91), PD28 (SEQ ID NO: 93) (lower right panel).
Figure 18:
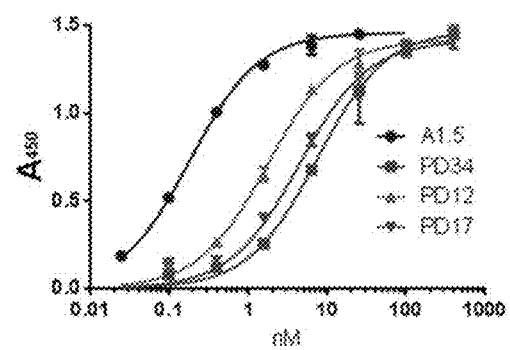
Figure 18:
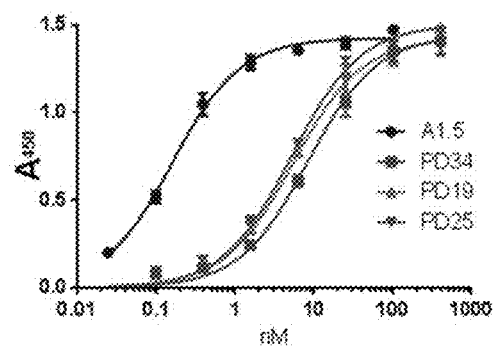
Figure 18:
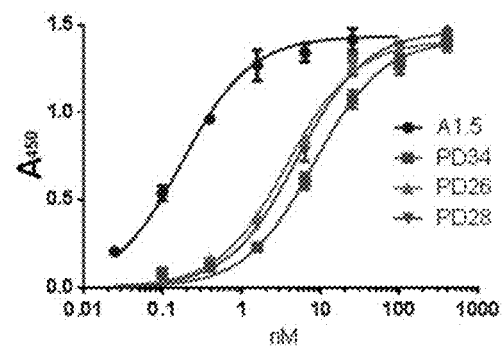

Masking efficiency values for activatable antibodies tested in FIG. 18

| Mask | ME |
|---|---|
| None | 1 |
| PD06 | 30 |
| PD09 | 2 |
| PD-12 | 10 |
| PD-17 | 20 |
| PD-19 | 30 |
| PD25 | 30 |
| PD26 | 20 |
| PD28 | 25 |
| PD34 | 42 |

TABLE 26

Figure 15:
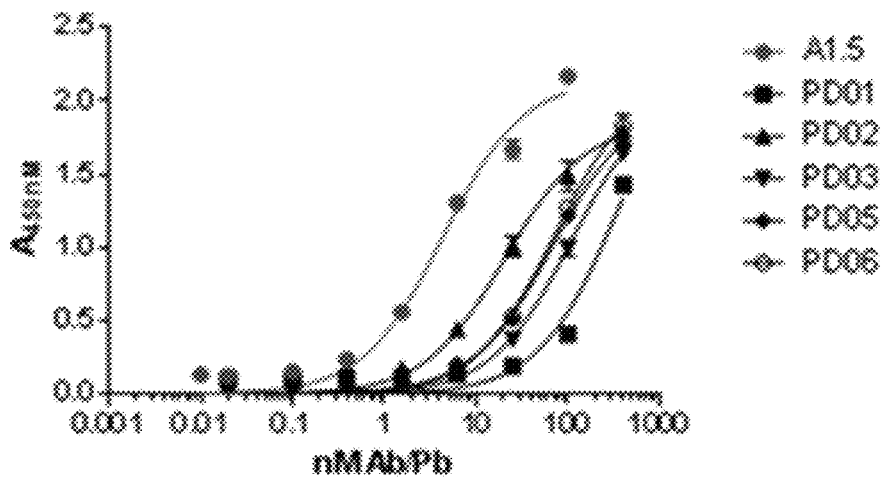
FIG. 15 is a series of graphs depicting the binding to hPD-1 by anti-PD-1 antibody A1.5 and by various activatable anti-PD-1 antibodies that include the anti-PD-1 antibody A1.5 and the masking moieties referred to herein as PD01 (SEQ ID NO: 66), PD02 (SEQ ID NO: 67), PD03 (SEQ ID NO: 68), PD05 (SEQ ID NO: 70), PD06 (SEQ ID NO: 71) (Plate 1); PD08 (SEQ ID NO: 73), PD09 (SEQ ID NO: 74), PD10 (SEQ ID NO: 75), PD11 (SEQ ID NO: 76), PD12 (SEQ ID NO: 77) (Plate 2); PD13 (SEQ ID NO: 78), PD14 (SEQ ID NO: 79), PD15 (SEQ ID NO: 80), PD16 (SEQ ID NO: 81), PD17 (SEQ ID NO: 82) (Plate 3); PD18 (SEQ ID NO: 83), PD19 (SEQ ID NO: 84), PD20 (SEQ ID NO: 85), PD21 (SEQ ID NO: 86), PD22 (SEQ ID NO: 87) (Plate 4); and PD23 (SEQ ID NO: 88), PD24 (SEQ ID NO: 89) (Plate 5).
Figure 15:
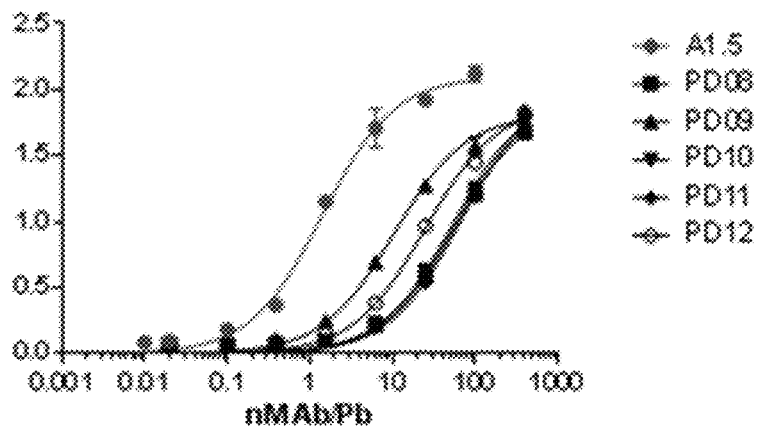
Figure 17:
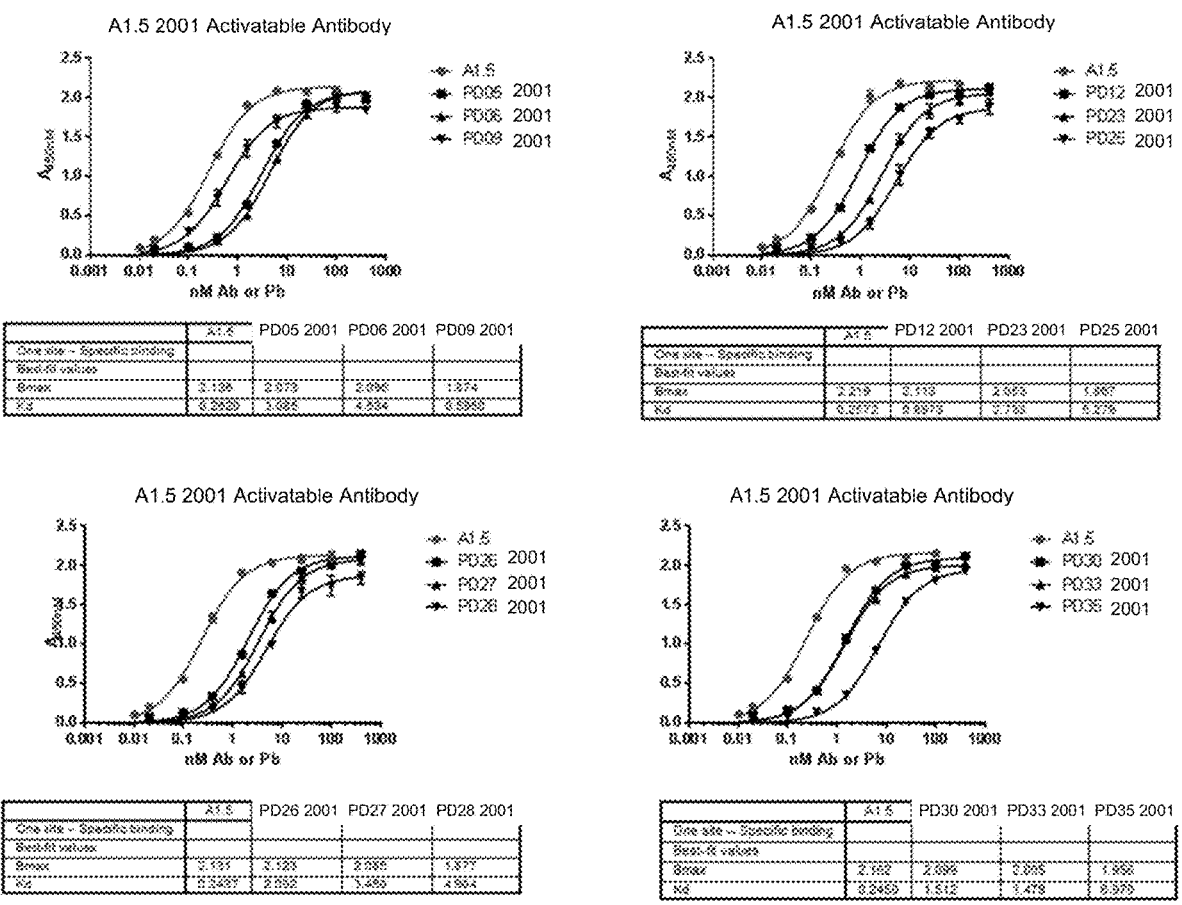
FIG. 17 is a series of graphs depicting the binding to hPD-1 by the anti-PD-1 antibody A1.5 and by various activatable anti-PD-1 antibodies that include the anti-PD-1 antibody A1.5, the cleavable moiety referred to herein as 2001, which includes the sequence ISSGLLSGRSDNH (SEQ ID NO: 214), and the masking moieties referred to herein as PD05 (SEQ ID NO: 70), PD06 (SEQ ID NO: 71), PD09 (SEQ ID NO: 74) (upper left panel); PD12 (SEQ ID NO: 77), PD23 (SEQ ID NO: 88), PD25 (SEQ ID NO: 90) (upper right panel); PD26 (SEQ ID NO: 91), PD27 (SEQ ID NO: 92), PD28 (SEQ ID NO: 93) (lower left panel); and PD30 (SEQ ID NO: 95), PD33 (SEQ ID NO: 98), PD35 (SEQ ID NO: 100) (lower right panel).

Apparent Kd and Masking efficiency values for activatable antibodies tested in FIG. 15

| Molecule | Apparent KD, nM | Masking Efficiency |
|---|---|---|
| A1.5 (n = 5 avg) | 1.8 | |
| PD01 | 348 | 193 |
| PD02 | 21 | 12 |
| PD03 | 109 | 61 |
| PD05 | 68 | 38 |
| PD06 | 71 | 39 |
| PD08 | 55 | 31 |
| PD09 | 10 | 6 |
| PD10 | 54 | 30 |
| PD11 | 67 | 37 |
| PD12 | 25 | 14 |
| PD13 | 151 | 84 |
| PD14 | 100 | 56 |
| PD15 | 117 | 65 |
| PD16 | 57 | 32 |
| PD17 | 22 | 12 |
| PD18 | 75 | 42 |
| PD19 | 93 | 52 |
| PD20 | 77 | 43 |
| PD21 | 49 | 27 |
| PD22 | 41 | 23 |
| PD23 | 31 | 17 |
| PD24 | 92 | 51 |

Figure 19:
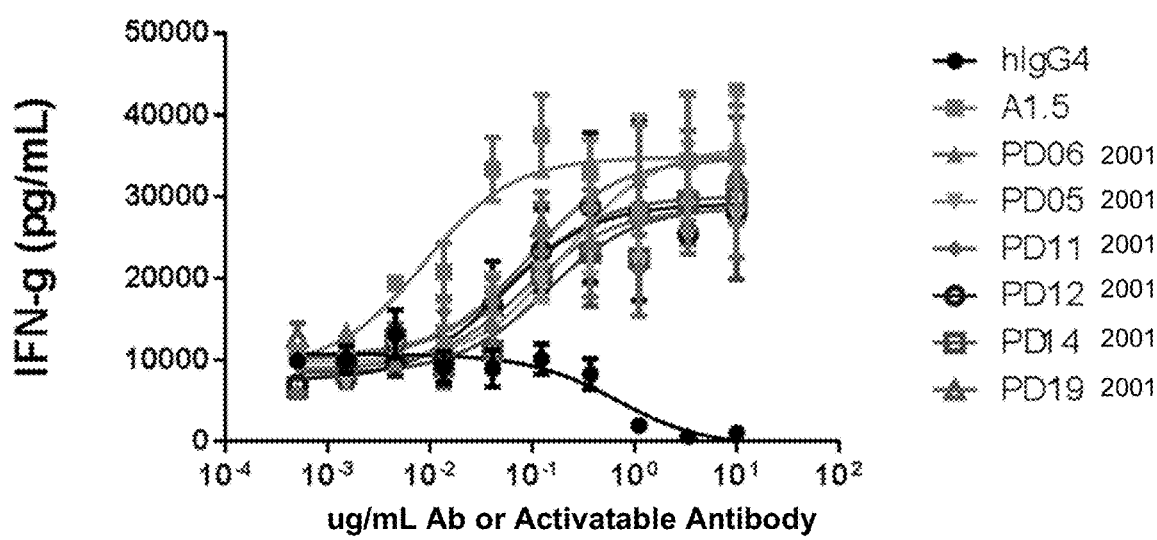
FIG. 19 is a graph depicting the ability of anti-PD1 A1.5 activatable antibodies of the disclosure to increase CMV-stimulated IFN-gamma secretion as compared to control hIgG4, but with decreased potency relative to anti-PD1 A1.5 parental antibody. The tested activatable antibodies include the anti-PD-1 antibody A1.5, the cleavable moiety referred to herein as 2001, and the masking moieties referred to herein as PD06, PD05, PD11, PD12, PD14, and PD19.

Example 11: Anti-PD-1 Activatable Antibodies of the Embodiments are Functionally Masked in a Human T-Cell Restimulation Assay This example describes the effect of masking moieties on the biological function of the anti-PD-1 antibody. (FIG. 19) PBMCs from a CMV-positive donor (Hemacare) were plated at $2 \times 10^5$ cells/well in the presence of CMV viral lysate (Astarte) and either anti-PD-1 antibody A1.5, an anti-PD-1 activatable antibody of the disclosure, or hIgG4 isotype control antibody. After four days, supernatant was removed from each well and IFN-gamma levels were assayed using IFN-gamma ELISA kit (Life Technologies, Carlsbad, Calif.). Anti-PD-1 A1.5 activatable antibodies increased CMV-stimulated IFN-gamma secretion compared with control hIgG4 but with decreased potency relative to anti-PD-1 A1.5 parental antibody (FIG. 19).

Example 12: Anti Mouse PD-1 J43v2 mIgG2a Antibody Binds Mouse PD-1 and Blocks Mouse PD-L1 and Mouse PD-L2 Binding This example demonstrates that Armenian hamster anti mouse PD-1 J43 antibody (U.S. Pat. No. 7,858,746; Agata et al, 1996, International Immunology, Vol. 8 No. 5 pp 765-77) can be functionally expressed as a mouse IgG2a antibody.

Anti-mouse PD-1 antibody J43 was reformatted as a hamster LC (SEQ ID NO: 543 amino acid; SEQ ID NO: 544 or SEQ ID NO: 545 nucleotide), mouse IgG2a antibody by fusion of the heavy chain variable domain to mIgG2a, resulting in amino acid SEQ ID NO 546, nucleotide sequence SEQ ID NO 547. Full length J43v2 mIgG2a (also referred to as J43v2, J43 m2a and J43v2 m2a) was expressed by transient transfection of HEK293 cells and purified from the culture supernatant by Protein G chromatography. One embodiment of this disclosure is an antibody comprising a light chain comprising amino acid sequence SEQ ID NO: 543. One embodiment of this disclosure is an antibody comprising a heavy chain comprising amino acid sequence SEQ ID NO: 546. One embodiment of this disclosure is an antibody comprising a light chain comprising amino acid sequence SEQ ID NO: 543 and a heavy chain comprising amino acid sequence SEQ ID NO: 546. One embodiment of this disclosure is an antibody comprising the CDRs of an antibody comprising a light chain comprising amino acid sequence SEQ ID NO: 543 and a heavy chain comprising amino acid sequence SEQ ID NO: 546.

Figure 20A:
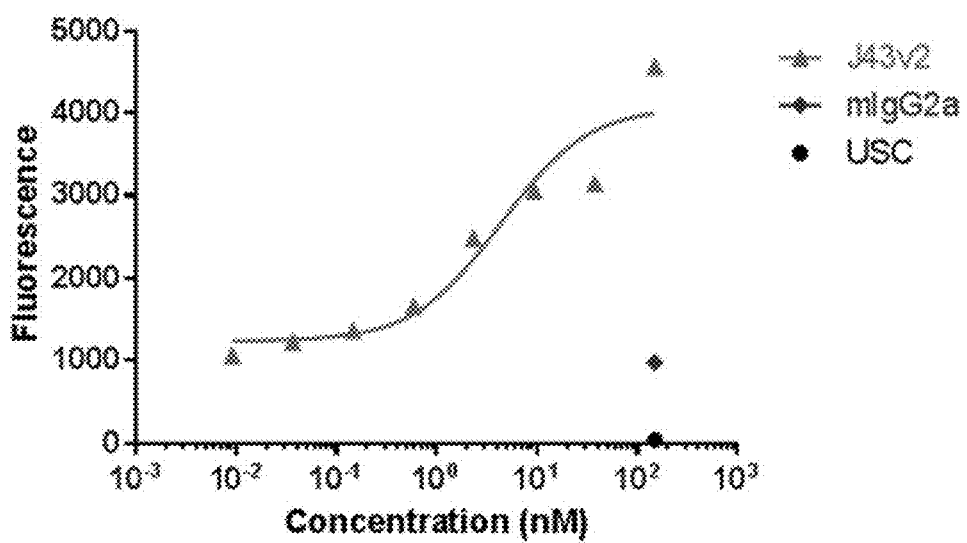
FIGS. 20A and 20B are a series of graphs depicting the ability of the anti-PD-1 antibody referred to herein as J43v2 (Heavy Chain (HC): SEQ ID NO: 546; Light Chain (LC): SEQ ID NO: 543) to block murine PD-L1 (mPD-L1) and murine PD-L2 (mPD-L2) from binding to cells expressing murine PD-1 (mPD-1) with single digit nM $EC_{50}$ values.
Figure 20B:
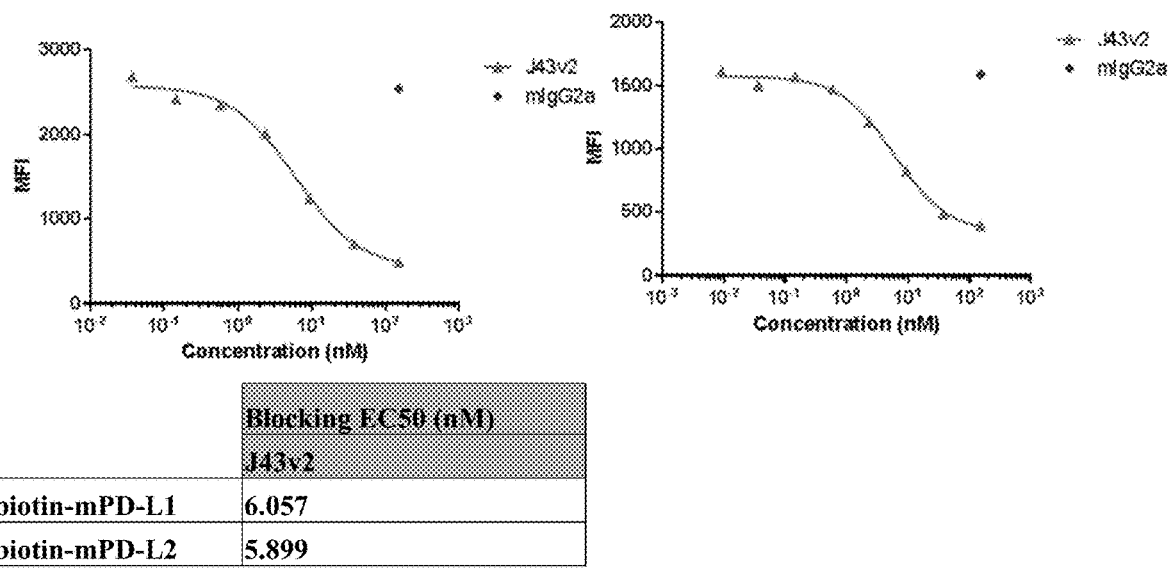

Functionality was assayed by binding of J43v2 m2a to HEK293 cells expressing mouse PD-1 and confirmation that binding of J43v2 m2a to HEK293-mPD-1 inhibited binding of biotinylated mPD-L1 and biotinylated mPD-L2 to HEK293-mPD-1 (FIG. 20). About 100,000 mPD-1 HEK293 cells were transferred to a U-bottom 96-well plate. For the binding experiment, a 1:4 titration of J43v2 m2a antibody starting at 150 nM was added to cells. For blocking experiments, 20 nM of biotinylated-mPD-L1-Fc or 20 nM of biotinylated-mPD-L2-Fc were premixed with a 1:4 titration of J43v2 m2a starting at 150 nM and added to cells. Both were incubated for 1 hour on ice and cells were washed 3 times. J43v2 m2a antibody binding was detected using an anti-mouse secondary antibody (Jackson Immunoresearch, West Grove, Pa.). For the blocking experiment, biotinylated-PD-L1 or biotinylated-PD-L2 was detected using streptavidin-PE (Life Technologies, Carlsbad, Calif.). Both binding and blocking were incubated for 30 minutes on ice and were washed and read on a flow cytometer (MACSQuant).

Example 13: J43v2 m2a Induces Diabetes in NOD Mouse Model

In this Example, anti-PD-1 J43v2 m2a antibody was confirmed to induce diabetes in the NOD mouse model.

Figure 21:
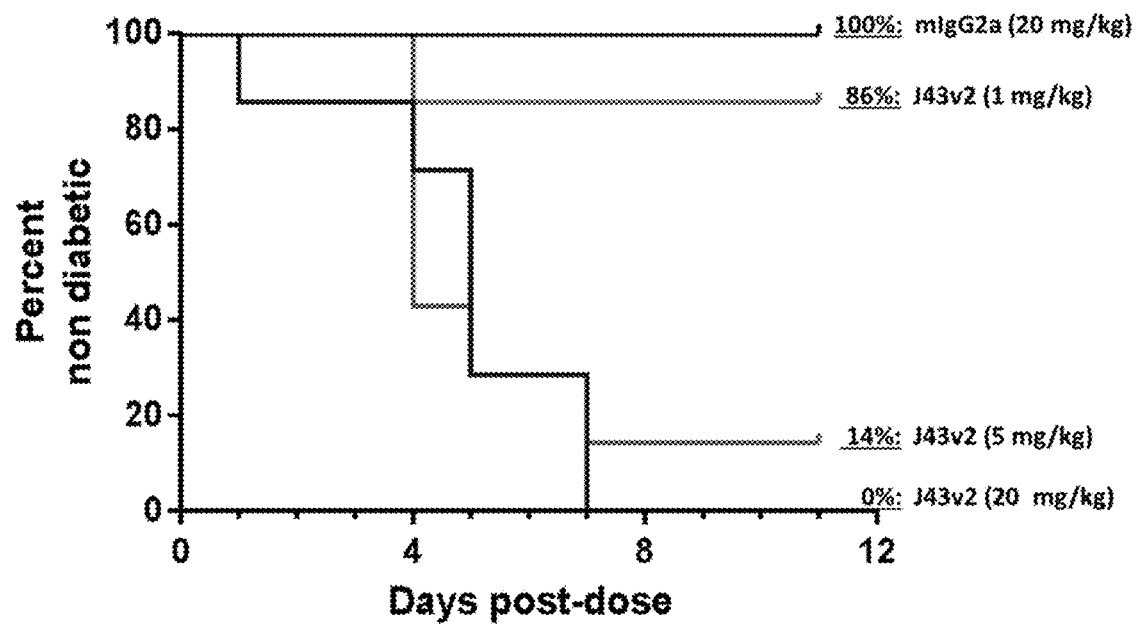
FIG. 21 is a graph depicting the dose-dependent induction of diabetes in NOD mice by the antibody referred to herein as J43v2 m2a (HC: SEQ ID NO: 546; LC: SEQ ID NO: 543).

Antibody J43v2 m2a was confirmed to induce diabetes in NOD mice as follows. The NOD mice, substrain NOD/ShiLtJ were obtained from Jackson Laboratory at 8 weeks and acclimated on site for 2 weeks. At 10 weeks, mice were checked for diabetes prior to enrollment, grouped, and dosed as set forth in Table 16. FIG. 21 shows the dose-dependent induction of diabetes in NOD mice by J43v2 m2a. At day eight after a single dose, 100% of mice in the mIgG2a isotype control group remained non-diabetic, while 0%, 14% and 86% of the 20 mg/kg, 3 mg/kg and 1 mg/kg groups, respectively, remained non-diabetic.

TABLE 16

Study design

| Group | Count | Gender | Treatment | Dose (mg/kg) | Dose volume (mL/kg) | Schedule | Route |
|---|---|---|---|---|---|---|---|
| 1 | 7 | F | mIgG2a (C1.18.4) | 20 | 10 | q7dx1 | IP |
| 2 | 7 | F | Anti-PD-1 (J43v2) | 20 | 10 | q7dx1 | IP |
| 3 | 7 | F | Anti-PD-1 (J43v2) | 5 | 10 | q7dx1 | IP |
| 4 | 7 | F | Anti-PD-1 (J43v2) | 1 | 10 | q7dx1 | IP |

Example 14: Activatable Anti-Mouse PD-1 J43 Masking Moieties

This example describes identification of masking moieties (MM) that reduce binding of anti-PD-1 J43 antibody to its target.

Anti-PD-1 J43v2 mIgG2a was used to screen libraries using a method similar to that described in PCT International Publication Number WO 2010/081173, published 15 Jul. 2010. The screening consisted of one round of MACS and three rounds of FACS sorting. For the initial MACS, approximately $1\times10^{12}$ cells were incubated with J43v2 m2a antibody at a concentration of 200 nM, and approximately $9\times10^{7}$ binders were collected using Protein-G Dynabeads (Life Technologies, Carlsbad, Calif.). FACS rounds were conducted labeling cells with DyLight 650 (Thermo-Fisher) labeled J43v2 m2a antibody and collecting cells with strongest fluorescence as follows: 200 nM J43-650 collecting brightest 3% for FACS round 1 (F1), 20 nM J43-650 collecting brightest 8% for FACS round 2 (F2) and 1 nM J43-650 collecting two populations, the brightest 20% and the brightest 0.5% for FACS round 3 (F3-20 and F3-0.5). Individual peptide clones from F2, F3-20 and F3-0.5 were identified by sequence analysis (Table 17), and selected peptide clones MP001-MP014 were subsequently verified for their ability to bind J43-650 (masking moiety MP001 is also referred to herein as MP01 and/or MP-01; masking moiety MP002 is also referred to herein as MP02 and/or MP-02, and so on).

TABLE 17

Masking moiety sequences

| Mask | Amino Acid Sequence | SEQ ID NO: |
|---|---|---|
| MP001 | DYTYCRWVNWCLSGV | 384 |
| MP002 | ILCPEDPWGHKCKLP | 385 |
| MP003 | TNIWSCQTYCDHKHK | 386 |
| MP004 | SDHKCKLQNCMNTKV | 387 |
| MP005 | PGNCHPMQKEMCQFI | 388 |
| MP006 | VEHLCYTHNKCKHPD | 389 |
| MP007 | TIPRCGQHPKCKDTL | 390 |
| MP008 | ACRICQDHPKTKWNS | 391 |
| MP009 | LIQCTGNLDHKCKHY | 392 |
| MP010 | IPCHHSADHKHKCTS | 393 |
| MP011 | SRQICADYNCHNKYK | 394 |

TABLE 17-continued

Masking moiety sequences

| Mask | Amino Acid Sequence | SEQ ID NO: |
|---|---|---|
| MP012 | QPCNPQIDHKIKCIY | 395 |
| MP013 | HYTICMTHNKCKDMA | 396 |
| MP014 | ANSCLAVEHKCKHNY | 397 |

TABLE 17-continued Masking moiety sequences

| Mask | Amino Acid Sequence | SEQ ID NO: |
|---|---|---|
| MP015 | AALHCTEHKCKNHIK | 398 |
| MP016 | APCIINTVDWKSCEI | 399 |
| MP017 | ATNWCTHKQKCKQDM | 400 |
| MP018 | DCYNEHKLKTRVCNN | 401 |
| MP019 | DEMQCSHKQKCTNSK | 402 |
| MP020 | DVGICSQHNKCKPTK | 403 |
| MP021 | EKYCSSDDHKCKITL | 404 |
| MP022 | ELECSHNKVKNCIQI | 405 |
| MP023 | ELHPCNTHKCKPIVN | 406 |
| MP024 | EVGSCNHPKCKSNNY | 407 |
| MP025 | EYSPSLAHPKLKDNA | 408 |
| MP026 | FESLHPKGKHPEDLG | 409 |
| MP027 | FPLCVRADRVCGDAQ | 410 |
| MP028 | FQAPPASHNKLKPSL | 411 |
| MP029 | GAIDSCHHKCKSPHY | 412 |
| MP030 | GKIYTCEHNCTFGYS | 413 |
| MP031 | HCTVNNHSSDHKCKI | 414 |
| MP032 | HGTQCTHNKCKPILS | 415 |
| MP033 | HIGWCLHPKCKTTTT | 416 |
| MP034 | HLRTCIQKWCEHKMK | 417 |
| MP035 | HTDCTMMSNHKCKIN | 418 |
| MP036 | IRQQCTALACLLKVH | 419 |
| MP037 | KGCSTHKMRAYCNQM | 420 |
| MP038 | KMFTPCKIWCNNSYN | 421 |
| MP039 | KTMCSGHKQKCNNSS | 422 |
| MP040 | LACHSASLVDHKCKL | 423 |
| MP041 | LCNVSMDHKHKPCYL | 424 |
| MP042 | LGLNCFSEHKCKEHM | 425 |
| MP043 | LGTCTHKHKNCNYTL | 426 |
| MP044 | LHEGCTTHNKCKPIA | 427 |
| MP045 | LKRSCTGHWTCYTNW | 428 |
| MP046 | LQRCTHKEKYCHAIH | 429 |
| MP047 | LSHCYDHKRKCSYIV | 430 |
| MP048 | LSKCHNKEKNCSNNN | 431 |
| MP049 | MDTCEMHKQKCRPSF | 432 |
| MP050 | MHNECLTHKCKVPIT | 433 |
| MP051 | MLTLCNTNACHKEKN | 434 |
| MP052 | MRPCLNNLEHKCKHY | 435 |
| MP053 | MSRCPTHKMKCSLNI | 436 |
| MP054 | MWICQEHKLKCMTDT | 437 |
| MP055 | MYYCKRRSAFYCTLN | 438 |
| MP056 | NDCQHDKQMHKCKMH | 439 |
| MP057 | NFGPCPMLLGCFGFR | 440 |
| MP058 | NHTDCSHPKCKSHDS | 441 |
| MP059 | NLNCPHKQKNCDKYH | 442 |
| MP060 | NPQCTPIDHKCKTHH | 443 |
| MP061 | NTTSCTHPKCKHQGK | 444 |
| MP062 | NVGGCDNYGCHKLKN | 445 |
| MP063 | PCSPGNLTWDHKCKY | 446 |
| MP064 | PFTKCHGFNKCKEHT | 447 |
| MP065 | PGDKCTHKEKCYYNN | 448 |
| MP066 | PNICNLDHKRKCRIN | 449 |
| MP067 | PQLACKHPKCKDAGN | 450 |
| MP068 | PSCTMWTHGGVCKHA | 451 |
| MP069 | PSHRHPLAKPGFRVE | 452 |
| MP070 | PTCFKTHNKSKCNRV | 453 |
| MP071 | PTPVCHHNFHCFGYD | 454 |
| MP072 | QATCQWKKRSKCHNK | 455 |
| MP073 | QHSWCQHKAKCNYGN | 456 |
| MP074 | QNCSPTYTTHKCKLT | 457 |
| MP075 | QSSNCEHKRKCSSIS | 458 |
| MP076 | RPCLLGLVPDHKCKL | 459 |
| MP077 | RRSCMRSINTCKQKY | 460 |
| MP078 | RSSCPTVTPQNCENQ | 461 |
| MP079 | RTMCLDLNHKCKPSN | 462 |
| MP080 | RTYWCTNHNKCKHNM | 463 |
| MP081 | RVENCEHNQYCHKWK | 464 |
| MP082 | SCHEDDHKNKNICSL | 465 |
| MP083 | SDTCVMNHPKCKRDN | 466 |
| MP084 | SSTCFHPNQKECMTK | 467 |
| MP085 | SSYCGGITMRCRRAM | 468 |
| MP086 | STGYCTYVNWCNYTN | 469 |
| MP087 | THKCKLHLQVCTQTT | 470 |
| MP088 | TMNCTHPKQKCQHTN | 471 |
| MP089 | TNVLCESHNCDHKNK | 472 |
| MP090 | TQHAASLGVEHKSKI | 473 |

TABLE 17-continued

Masking moiety sequences

| Mask | Amino Acid Sequence | SEQ ID NO: |
|------|---------------------|------------|
| MP091 | TQLPCFDDHKCKNTN | 474 |
| MP092 | TSDSCMRQKCEHKEK | 475 |
| MP093 | TTCDDHKYKHKCAQL | 476 |
| MP094 | TTCGAHKEKQHCIYT | 477 |
| MP095 | TTYCAYWHNKCKFET | 478 |
| MP096 | VGPTCGHAKCKQSEV | 479 |
| MP097 | VSHPCNTHKCKTNIV | 480 |
| MP098 | WDCRNTSHPKLKCHN | 481 |
| MP099 | WSPCNSDHKRKCNNG | 482 |
| MP100 | YANMSCEYDCHKMKY | 483 |
| MP101 | YANPCTHKEKCHFKN | 484 |
| MP102 | YDCSPSWTHPKCKHK | 485 |
| MP103 | YGWTCTTHPKCKTTN | 486 |
| MP104 | YQKCHPKAKDCGNNT | 487 |
| MP105 | YWECPNMEHNKCKNN | 488 |
| MP106 | PMGNRYCVLDHPKLK | 489 |
| MP107 | GHKSCCQKHCEYTQT | 490 |
| MP108 | LYLEMCSCCCWESIT | 491 |
| MP109 | ACQAQHCYKTYACKP | 492 |
| MP110 | CCYTCSVHPKCKNQL | 493 |
| MP111 | CKHRCSHKEKCPANH | 494 |
| MP112 | CHVLFCLMQCCRWSL | 495 |
| MP113 | LNSSLVFDHPKAKPN | 496 |
| MP114 | MCLLCRSKFGCKVKG | 497 |
| MP115 | IICNDHKCKQNQCNN | 498 |
| MP116 | IRCSLRDSLCGCERM | 499 |
| MP117 | TSCQPPKHKCTCNHG | 500 |
| MP118 | TQCPHRCVKPNCWLH | 501 |
| MP119 | KCCETKRNHKHCTYK | 502 |
| MP120 | LPHCCHKAKHCNHTS | 503 |
| MP121 | PAMCAAIHEKCCIKV | 504 |
| MP122 | PRSCGNQLCPCHYYK | 505 |
| MP123 | TNKCSCNHNMKCINY | 506 |
| MP124 | VETCCQHNKCKYPFI | 507 |
| MP125 | IFCCSNHEDHKCKTN | 508 |
| MP126 | VCRLICPLTCVIGVG | 509 |
| MP127 | FHGCCSVYSCLTNPG | 510 |
| MP128 | ALACHPKQKPLEGQL | 511 |
| MP129 | SIICCATSSCPLKHL | 512 |
| MP130 | APCCRPHKEKPIDSR | 513 |
| MP131 | WELCCPSADCRVAMG | 514 |

Example 15: Characterization of Activatable Anti-Mouse PD-1 Antibodies

This example describes activatable anti-PD-1 antibodies of the disclosure with reduced binding to hPD-1 compared to binding by parental antibody.

Figure 22:
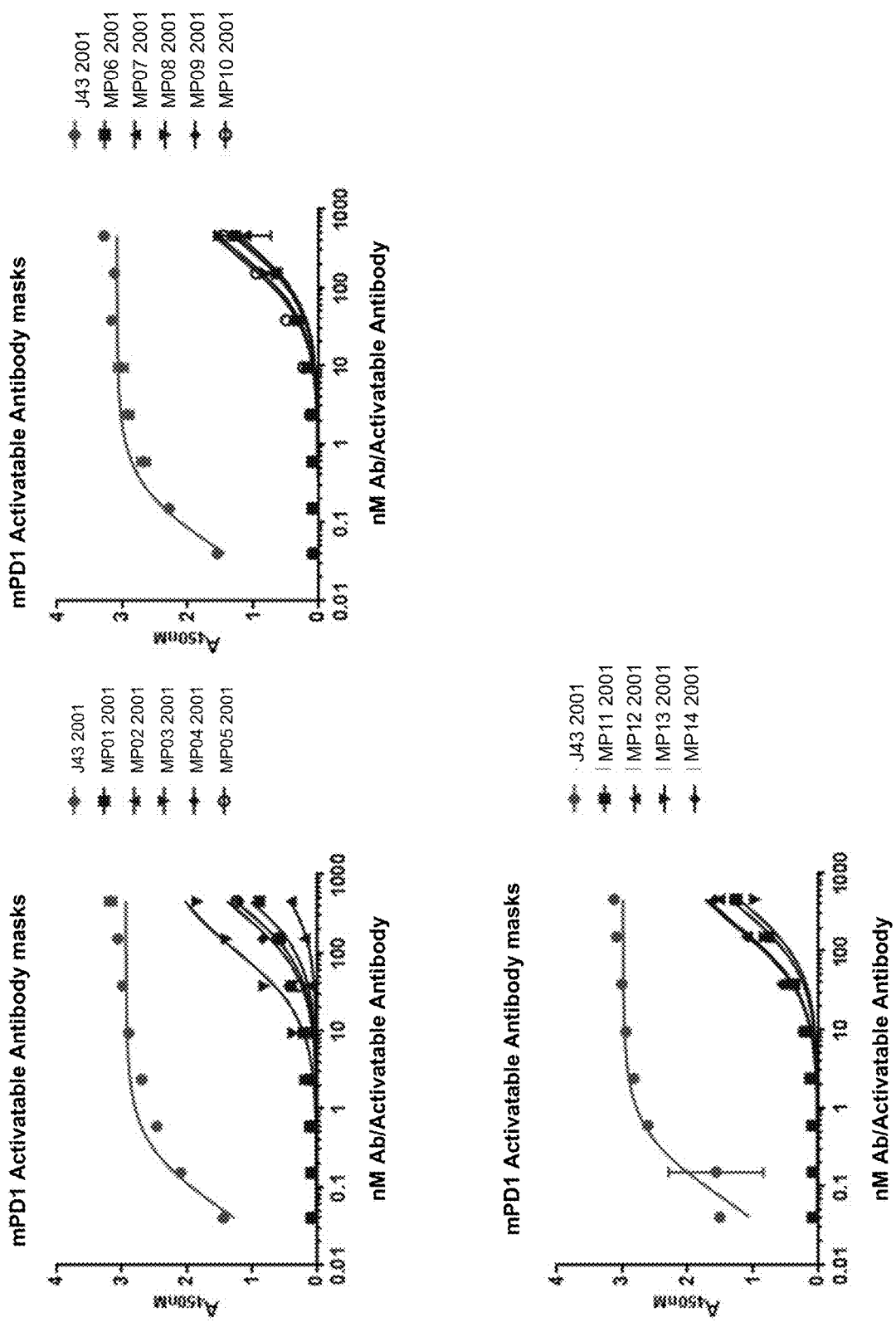
FIG. 22 is a series of graphs depicting the binding to hPD-1 by anti-PD-1 antibody J43v2 m2a and by various activatable anti-PD-1 antibodies that include the anti-PD-1 antibody J43v2 m2a and the masking moieties referred to herein as MP01 (SEQ ID NO: 384), MP02 (SEQ ID NO: 385), MP03 (SEQ ID NO: 386), MP04 (SEQ ID NO: 387), MP05 (SEQ ID NO: 388) (upper left panel); MP06 (SEQ ID NO: 389), MP07 (SEQ ID NO: 390), MP08 (SEQ ID NO: 391), MP09 (SEQ ID NO: 392), MP10, also referred to herein as MP010 (SEQ ID NO: 393) (upper right panel); MP11, also referred to herein as MP011 (SEQ ID NO: 394), MP12, also referred to herein as MP012 (SEQ ID NO: 395), MP13, also referred to herein as MP013 (SEQ ID NO: 396), MP14, also referred to herein as MP014 (SEQ ID NO: 397) (bottom panel).

Masking efficiencies were evaluated by standard plate ELISA. Briefly, mouse PD-1-Fc (R and D systems, Minneapolis, Minn.) was adsorbed to the wells of a 96-well ELISA plate. Purified J43v2 and activatable J43v2 antibodies comprising the indicated masks, cleavable moiety 2001, and antibody J43v2 were applied to the plate in serial dilution and allowed to bind. Bound antibody and activatable antibodies were detected with anti-mouse IgG-HRP conjugate (Sigma, St Louis, Mo.) and visualized with the chromogenic substrate TMB (Thermo Scientific, Rockford, Ill.). Plots were generated in Prizm (Sigma Plot). All activatable J43 antibodies showed strongly decreased binding compared with the parental J43 (FIG. 22).

In some embodiments, the activatable antibody also includes a spacer sequence. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. In some embodiments, the spacer joined directly to the N-terminus of MM of the activatable antibody is selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. In some embodiments, the spacer includes at least the amino acid sequence QGQSGQG (SEQ ID NO: 362). In some embodiments, the spacer includes at least the amino acid sequence QGQSGQ (SEQ ID NO: 913). In some embodiments, the spacer includes at least the amino acid sequence QGQSG (SEQ ID NO: 914). In some embodiments, the spacer includes at least the amino acid sequence QGQS (SEQ ID NO: 915), In some embodiments, the spacer includes at least the amino acid sequence QGQ (SEQ ID NO: 916). In some embodiments, the spacer includes at least the amino acid sequence QG (SEQ ID NO: 917). In some embodiments, the spacer includes at least the amino acid residue Q. In some embodiments, the activatable antibody does not include a spacer sequence.

Additional examples of spacers include GQSGQG (SEQ ID NO: 2042), QSGQG (SEQ ID NO: 2043), SGQG (SEQ ID NO: 2044), GQG (SEQ ID NO: 2045), QG (SEQ ID NO: 2046), and G.

While the sequences shown below include the spacer sequence of SEQ ID NO: 362, those of ordinary skill in the art appreciate that the activatable anti-PD-1 antibodies of the disclosure can include any suitable spacer sequence, such as, for example, a spacer sequence selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. Additional examples of spacers include GQSGQG (SEQ ID NO: 2042), QSGQG (SEQ ID NO: 2043), SGQG (SEQ ID NO: 2044), GQG (SEQ ID NO:

2045), QG (SEQ ID NO: 2046), and G. While the sequences shown below include the spacer sequence of SEQ ID NO: 362, those of ordinary skill in the art will also appreciate that activatable anti-PD-1 antibodies of the disclosure in some embodiments do not include a spacer sequence.

Activatable Anti-Mouse PD-1 Light Chain Variable Domains

[Spacer (SEQ ID NO: 362)] [J43 MP001 2001 (SEQ ID NO: 999)] Amino Acid Sequence:

(SEQ ID NO: 515)
[QGQSGQG][DYTYCRWVNWCLSGVGGGSSGGSISSGLLSGRSDNHGG
GSYELTQPPSASVNVGETVKITCSGDQLPKYFADWFHQRSDQTILQVIYD
DNKRPSGIPERISGSSSGTTATLTIRDVRAEDEGDYYCFSGYVDSDSKLY
VFGSGTQLTVL]

J43 MP001 2001 Amino Acid Sequence:

(SEQ ID NO: 1077)
DYTYCRWVNWCLSGVGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP001 2001 (SEQ ID NO: 1000)] Nucleic Acid Sequence:

(SEQ ID NO: 516)
[CAAGGCCAGTCTGGCCAAGGT][GATTATACGTATTGCCGTTGGGTTA
ATTGGTGCTTGTCTGGGGTGGGAGGTGGCTCGAGCGGCGGCTCTATCTCT
TCCGGACTGCTGTCCGGCAGATCCGACAATCACGGCGGAGGCTCTTATGA
GCTGACTCAGCCACCTTCAGCATCAGTCAATGTAGGAGAGACTGTCAAAA
TCACCTGCTCTGGGGACCAATTGCCGAAATATTTTGCAGATTGGTTTCAT
CAAAGGTCAGACCAGACCATTTTGCAAGTGATATATGATGATAATAAGCG
CCCCTCGGGTATCCCTGAAAGAATCTCTGGGTCCAGCTCAGGGACAACAG
CCACCTTGACCATCAGAGATGTCCGGGCTGAGGATGAAGGTGACTATTAC
TGTTTCTCAGGATATGTTGATAGTGATAGCAAATTGTATGTTTTTGGCAG
CGGAACCCAGCTCACCGTCCT

[Spacer (SEQ ID NO: 362)] [J43 MP002 2001 (SEQ ID NO: 1001)] Amino Acid Sequence:

(SEQ ID NO: 517)
[QGQSGQG][ILCPEDPWGHKCKLPGGGSSGGSISSGLLSGRSDNHGGG
SYELTQPPSASVNVGETVKITCSGDQLPKYFADWFHQRSDQTILQVIYDD
NKRPSGIPERISGSSSGTTATLTIRDVRAEDEGDYYCFSGYVDSDSKLYV
FGSGTQLTVL]

J43 MP002 2001 Amino Acid Sequence:

(SEQ ID NO: 1078)
ILCPEDPWGHKCKLPGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP002 2001 (SEQ ID NO: 1002)] Nucleic Acid Sequence:

(SEQ ID NO: 518)
[CAAGGCCAGTCTGGCCAAGGT][ATTCTGTGCCCGGAGGATCCGTGGG
GGCATAAGTGCAAGCTGCCTGGAGGTGGCTCGAGCGGCGGCTCTATCTCT
TCCGGACTGCTGTCCGGCAGATCCGACAATCACGGCGGAGGCTCTTATGA
GCTGACTCAGCCACCTTCAGCATCAGTCAATGTAGGAGAGACTGTCAAAA
TCACCTGCTCTGGGGACCAATTGCCGAAATATTTTGCAGATTGGTTTCAT
CAAAGGTCAGACCAGACCATTTTGCAAGTGATATATGATGATAATAAGCG
CCCCTCGGGTATCCCTGAAAGAATCTCTGGGTCCAGCTCAGGGACAACAG
CCACCTTGACCATCAGAGATGTCCGGGCTGAGGATGAAGGTGACTATTAC
TGTTTCTCAGGATATGTTGATAGTGATAGCAAATTGTATGTTTTTGGCAG
CGGAACCCAGCTCACCGTCCTA

[Spacer (SEQ ID NO: 362)] [J43 MP003 2001 (SEQ ID NO: 1003)] Amino Acid Sequence:

(SEQ ID NO: 519)
[QGQSGQG][TNIWSCQTYCDHKHKGGGSSGGSISSGLLSGRSDNHGGG
SYELTQPPSASVNVGETVKITCSGDQLPKYFADWFHQRSDQTILQVIYDD
NKRPSGIPERISGSSSGTTATLTIRDVRAEDEGDYYCFSGYVDSDSKLYV
FGSGTQLTVL

J43 MP003 2001 Amino Acid Sequence:

(SEQ ID NO: 1079)
TNIWSCQTYCDHKHKGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP003 2001 (SEQ ID NO: 1004)] Nucleic Acid Sequence:

(SEQ ID NO: 520)
[CAAGGCCAGTCTGGCCAAGGT][ACGAATATTTGGAGTTGCCAGACTTA
TTGCGATCATAAGCATAAGGGAGGTGGCTCGAGCGGCGGCTCTATCTCT
TCCGGACTGCTGTCCGGCAGATCCGACAATCACGGCGGAGGCTCTTATGA
GCTGACTCAGCCACCTTCAGCATCAGTCAATGTAGGAGAGACTGTCAAAA
TCACCTGCTCTGGGGACCAATTGCCGAAATATTTTGCAGATTGGTTTCAT
CAAAGGTCAGACCAGACCATTTTGCAAGTGATATATGATGATAATAAGCG
CCCCTCGGGTATCCCTGAAAGAATCTCTGGGTCCAGCTCAGGGACAACAG
CCACCTTGACCATCAGAGATGTCCGGGCTGAGGATGAAGGTGACTATTAC
TGTTTCTCAGGATATGTTGATAGTGATAGCAAATTGTATGTTTTTGGCAG
CGGAACCCAGCTCACCGTCCTA

[Spacer (SEQ ID NO: 362)] [J43 MP004 2001 (SEQ ID NO: 1005)] Amino Acid Sequence:

(SEQ ID NO: 521)
[QGQSGQG][SDHKCKLQNCMNTKVGGGSSGGSISSGLLSGRSDNHGGG
SYELTQPPSASVNVGETVKITCSGDQLPKYFADWFHQRSDQTILQVIYDD
NKRPSGIPERISGSSSGTTATLTIRDVRAEDEGDYYCFSGYVDSDSKLYV
FGSGTQLTVL]

J43 MP004 2001 Amino Acid Sequence:

(SEQ ID NO: 1080)
SDHKCKLQNCMNTKVGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP004 2001 (SEQ ID NO: 1006)] Nucleic Acid Sequence:

(SEQ ID NO: 522)
[CAAGGCCAGTCTGGCCAAGGT][AGTGATCATAAGTGCAAGCTTCAGA
ATTGCATGAATACTAAGGTTGGAGGTGGCTCGAGCGGCGGCTCTATCTCT
TCCGGACTGCTGTCCGGCAGATCCGACAATCACGGCGGAGGCTCTTATGA
GCTGACTCAGCCACCTTCAGCATCAGTCAATGTAGGAGAGACTGTCAAAA
TCACCTGCTCTGGGGACCAATTGCCGAAATATTTTGCAGATTGGTTTCAT
CAAAGGTCAGACCAGACCATTTTGCAAGTGATATATGATGATAATAAGCG
CCCCTCGGGTATCCCTGAAAGAATCTCTGGGTCCAGCTCAGGGACAACAG
CCACCTTGACCATCAGAGATGTCCGGGCTGAGGATGAAGGTGACTATTAC
TGTTTCTCAGGATATGTTGATAGTGATAGCAAATTGTATGTTTTTGGCAG
CGGAACCCAGCTCACCGTCCTA

[Spacer (SEQ ID NO: 362)] [J43 MP005 2001 (SEQ ID NO: 1007)] Amino Acid Sequence:

(SEQ ID NO: 523)
[QGQSGQG][PGNCHPMQKEMCQFIGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP005 2001 Amino Acid Sequence:

(SEQ ID NO: 1081)
PGNCHPMQKEMCQFIGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP005 2001 (SEQ ID NO: 1008)] Nucleic Acid Sequence:

(SEQ ID NO: 524)
[CAAGGCCAGTCTGGCCAAGGT][CCTGGTAATTGCCATCCTATGCAGAA
GGAGATGTGCCAGTTTATTGGAGGTGGCTCGAGCGGCGGCTCTATCTCTT
CCGGACTGCTGTCCGGCAGATCCGACAATCACGGCGGAGGCTCTTATGAG
CTGACTCAGCCACCTTCAGCATCAGTCAATGTAGGAGAGACTGTCAAAAT
CACCTGCTCTGGGGACCAATTGCCGAAATATTTTGCAGATTGGTTTCATC
AAAGGTCAGACCAGACCATTTTGCAAGTGATATATGATGATAATAAGCGC
CCCTCGGGTATCCCTGAAAGAATCTCTGGGTCCAGCTCAGGGACAACAGC
CACCTTGACCATCAGAGATGTCCGGGCTGAGGATGAAGGTGACTATTACT
GTTTCTCAGGATATGTTGATAGTGATAGCAAATTGTATGTTTTTGGCAGC
GGAACCCAGCTCACCGTCCTA

[Spacer (SEQ ID NO: 362)] [J43 MP006 2001 (SEQ ID NO: 1009)] Amino Acid Sequence:

(SEQ ID NO: 525)
[QGQSGQG][VEHLCYTHNKCKHPDGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP006 2001 Amino Acid Sequence:

(SEQ ID NO: 1082)
VEHLCYTHNKCKHPDGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP006 2001 (SEQ ID NO: 1010)] Nucleic Acid Sequence:

(SEQ ID NO: 526)
[CAAGGCCAGTCTGGCCAAGGT][GTTGAGCATTTGTGCTATACGCATAA
TAAGTGCAAGCATCCTGATGGAGGTGGCTCGAGCGGCGGCTCTATCTCTT
CCGGACTGCTGTCCGGCAGATCCGACAATCACGGCGGAGGCTCTTATGAG
CTGACTCAGCCACCTTCAGCATCAGTCAATGTAGGAGAGACTGTCAAAAT
CACCTGCTCTGGGGACCAATTGCCGAAATATTTTGCAGATTGGTTTCATC
AAAGGTCAGACCAGACCATTTTGCAAGTGATATATGATGATAATAAGCGC
CCCTCGGGTATCCCTGAAAGAATCTCTGGGTCCAGCTCAGGGACAACAGC
CACCTTGACCATCAGAGATGTCCGGGCTGAGGATGAAGGTGACTATTACT
GTTTCTCAGGATATGTTGATAGTGATAGCAAATTGTATGTTTTTGGCAGC
GGAACCCAGCTCACCGTCCTA

[Spacer (SEQ ID NO: 362)] [J43 MP007 2001 (SEQ ID NO: 1011)] Amino Acid Sequence:

(SEQ ID NO: 527)
[QGQSGQG][TIPRCGQHPKCKDTLGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP007 2001 Amino Acid Sequence:

(SEQ ID NO: 1083)
TIPRCGQHPKCKDTLGGGSSGGSISSGLLSGRSDNHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVL

[Spacer (SEQ ID NO: 918)] [J43 MP007 2001 (SEQ ID NO: 1012)] Nucleic Acid Sequence:

(SEQ ID NO: 528)
[CAAGGCCAGTCTGGCCAAGGT][ACTATTCCGAGGTGCGGTCAGCATCC

GAAGTGCAAGGATACTTTGGGAGGTGGCTCGAGCGGCGGCTCTATCTCTT

CCGGACTGCTGTCCGGCAGATCCGACAATCACGGCGGAGGCTCTTATGAG

CTGACTCAGCCACCTTCAGCATCAGTCAATGTAGGAGAGACTGTCAAAAT

CACCTGCTCTGGGGACCAATTGCCGAAATATTTTGCAGATTGGTTTCATC

AAAGGTCAGACCAGACCATTTTGCAAGTGATATATGATGATAATAAGCGC

CCCTCGGGTATCCCTGAAAGAATCTCTGGGTCCAGCTCAGGGACAACAGC

CACCTTGACCATCAGAGATGTCCGGGCTGAGGATGAAGGTGACTATTACT

GTTTCTCAGGATATGTTGATAGTGATAGCAAATTGTATGTTTTTGGCAGC

GGAACCCAGCTCACCGTCCTA

[Spacer (SEQ ID NO: 362)] [J43 MP008 2001 (SEQ ID NO: 1013)] Amino Acid Sequence:

(SEQ ID NO: 529)
[QGQSGQG][ACRICQDHPKTKWNSGGGSSGGSISSGLLSGRSDNHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVL]

J43 MP008 2001 Amino Acid Sequence:

(SEQ ID NO: 1084)
ACRICQDHPKTKWNSGGGSSGGSISSGLLSGRSDNHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVL

[Spacer (SEQ ID NO: 918)] [J43 MP008 2001 (SEQ ID NO: 1014)] Nucleic Acid Sequence:

(SEQ ID NO: 530)
[CAAGGCCAGTCTGGCCAAGGT][GCGTGCCGTATTTGTCAGGATCATCC

TAAGACGAAGTGGAATTCTGGAGGTGGCTCGAGCGGCGGCTCTATCTCTT

CCGGACTGCTGTCCGGCAGATCCGACAATCACGGCGGAGGCTCTTATGAG

CTGACTCAGCCACCTTCAGCATCAGTCAATGTAGGAGAGACTGTCAAAAT

CACCTGCTCTGGGGACCAATTGCCGAAATATTTTGCAGATTGGTTTCATC

AAAGGTCAGACCAGACCATTTTGCAAGTGATATATGATGATAATAAGCGC

CCCTCGGGTATCCCTGAAAGAATCTCTGGGTCCAGCTCAGGGACAACAGC

CACCTTGACCATCAGAGATGTCCGGGCTGAGGATGAAGGTGACTATTACT

GTTTCTCAGGATATGTTGATAGTGATAGCAAATTGTATGTTTTTGGCAGC

GGAACCCAGCTCACCGTCCTA

[Spacer (SEQ ID NO: 362)] [J43 MP009 2001 (SEQ ID NO: 1015)] Amino Acid Sequence:

(SEQ ID NO: 531)
[QGQSGQG][LIQCTGNLDHKCKHYGGGSSGGSISSGLLSGRSDNHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVL]

J43 MP009 2001 Amino Acid Sequence:

(SEQ ID NO: 1085)
LIQCTGNLDHKCKHYGGGSSGGSISSGLLSGRSDNHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVL

[Spacer (SEQ ID NO: 918)] [J43 MP009 2001 (SEQ ID NO: 1016)] Nucleic Acid Sequence:

(SEQ ID NO: 532)
[CAAGGCCAGTCTGGCCAAGGT][CTTATTCAGTGCACTGGTAATCTTGA

TCATAAGTGCAAGCATTATGGAGGTGGCTCGAGCGGCGGCTCTATCTCTT

CCGGACTGCTGTCCGGCAGATCCGACAATCACGGCGGAGGCTCTTATGAG

CTGACTCAGCCACCTTCAGCATCAGTCAATGTAGGAGAGACTGTCAAAAT

CACCTGCTCTGGGGACCAATTGCCGAAATATTTTGCAGATTGGTTTCATC

AAAGGTCAGACCAGACCATTTTGCAAGTGATATATGATGATAATAAGCGC

CCCTCGGGTATCCCTGAAAGAATCTCTGGGTCCAGCTCAGGGACAACAGC

CACCTTGACCATCAGAGATGTCCGGGCTGAGGATGAAGGTGACTATTACT

GTTTCTCAGGATATGTTGATAGTGATAGCAAATTGTATGTTTTTGGCAGC

GGAACCCAGCTCACCGTCCT

[Spacer (SEQ ID NO: 362)] [J43 MP010 2001 (SEQ ID NO: 1017)] Amino Acid Sequence:

(SEQ ID NO: 533)
[QGQSGQG][IPCHHSADHKHKCTSGGGSSGGSISSGLLSGRSDNHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVL]

J43 MP010 2001 Amino Acid Sequence:

(SEQ ID NO: 1086)
IPCHHSADHKHKCTSGGGSSGGSISSGLLSGRSDNHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVL

[Spacer (SEQ ID NO: 918)] [J43 MP010 2001 (SEQ ID NO: 1018)] Nucleic Acid Sequence:

(SEQ ID NO: 534)
[CAAGGCCAGTCTGGCCAAGGT][ATTCCTTGCCATCATAGTGCTGATCA
TAAGCATAAGTGCACGAGTGGAGGTGGCTCGAGCGGCGGCTCTATCTCTT
CCGGACTGCTGTCCGGCAGATCCGACAATCACGGCGGAGGCTCTTATGAG
CTGACTCAGCCACCTTCAGCATCAGTCAATGTAGGAGAGACTGTCAAAAT
CACCTGCTCTGGGGACCAATTGCCGAAATATTTTGCAGATTGGTTTCATC
AAAGGTCAGACCAGACCATTTTGCAAGTGATATATGATGATAATAAGCGC
CCCTCGGGTATCCCTGAAAGAATCTCTGGGTCCAGCTCAGGGACAACAGC
CACCTTGACCATCAGAGATGTCCGGGCTGAGGATGAAGGTGACTATTACT
GTTTCTCAGGATATGTTGATAGTGATAGCAAATTGTATGTTTTTGGCAGC
GGAACCCAGCTCACCGTCCTA

[Spacer (SEQ ID NO: 362)] [J43 MP011 2001 (SEQ ID NO: 1019)] Amino Acid Sequence:

(SEQ ID NO: 535)
[QGQSGQG][SRQICADYNCHNKYKGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP011 2001 Amino Acid Sequence:

(SEQ ID NO: 1087)
SRQICADYNCHNKYKGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP011 2001 (SEQ ID NO: 1020)] Nucleic Acid Sequence:

(SEQ ID NO: 536)
[CAAGGCCAGTCTGGCCAAGGT][TCGCGGCAGATTTGCGCTGATTATAA
TTGCCATAATAAGTATAAGGGAGGTGGCTCGAGCGGCGGCTCTATCTCTT
CCGGACTGCTGTCCGGCAGATCCGACAATCACGGCGGAGGCTCTTATGAG
CTGACTCAGCCACCTTCAGCATCAGTCAATGTAGGAGAGACTGTCAAAAT
CACCTGCTCTGGGGACCAATTGCCGAAATATTTTGCAGATTGGTTTCATC
AAAGGTCAGACCAGACCATTTTGCAAGTGATATATGATGATAATAAGCGC
CCCTCGGGTATCCCTGAAAGAATCTCTGGGTCCAGCTCAGGGACAACAGC
CACCTTGACCATCAGAGATGTCCGGGCTGAGGATGAAGGTGACTATTACT
GTTTCTCAGGATATGTTGATAGTGATAGCAAATTGTATGTTTTTGGCAGC
GGAACCCAGCTCACCGTCCTA

[Spacer (SEQ ID NO: 362)] [J43 MP012 2001 (SEQ ID NO: 1021)] Amino Acid Sequence:

(SEQ ID NO: 537)
[QGQSGQG][QPCNPQIDHKIKCIYGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP012 2001 Amino Acid Sequence:

(SEQ ID NO: 1088)
QPCNPQIDHKIKCIYGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP012 2001 (SEQ ID NO: 1022)] Nucleic Acid Sequence:

(SEQ ID NO: 538)
[CAAGGCCAGTCTGGCCAAGGT][CAGCCTTGCAATCCGCAGATTGATCA
TAAGATTAAGTGCATTTATGGAGGTGGCTCGAGCGGCGGCTCTATCTCTT
CCGGACTGCTGTCCGGCAGATCCGACAATCACGGCGGAGGCTCTTATGAG
CTGACTCAGCCACCTTCAGCATCAGTCAATGTAGGAGAGACTGTCAAAAT
CACCTGCTCTGGGGACCAATTGCCGAAATATTTTGCAGATTGGTTTCATC
AAAGGTCAGACCAGACCATTTTGCAAGTGATATATGATGATAATAAGCGC
CCCTCGGGTATCCCTGAAAGAATCTCTGGGTCCAGCTCAGGGACAACAGC
CACCTTGACCATCAGAGATGTCCGGGCTGAGGATGAAGGTGACTATTACT
GTTTCTCAGGATATGTTGATAGTGATAGCAAATTGTATGTTTTTGGCAGC
GGAACCCAGCTCACCGTCCTA

[Spacer (SEQ ID NO: 362)] [J43 MP013 2001 (SEQ ID NO: 1023)] Amino Acid Sequence:

(SEQ ID NO: 539)
[QGQSGQG][HYTICMTHNKCKDMAGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP013 2001 Amino Acid Sequence:

(SEQ ID NO: 1089)
HYTICMTHNKCKDMAGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP013 2001 (SEQ ID NO: 1024)] Nucleic Acid Sequence:

(SEQ ID NO: 540)
[CAAGGCCAGTCTGGCCAAGGT][CATTATACTATTTGCATGACGCATAA
TAAGTGCAAGGATATGGCGGGAGGTGGCTCGAGCGGCGGCTCTATCTCTT

CCGGACTGCTGTCCGGCAGATCCGACAATCACGGCGGAGGCTCTTATGAG

CTGACTCAGCCACCTTCAGCATCAGTCAATGTAGGAGAGACTGTCAAAAT

CACCTGCTCTGGGGACCAATTGCCGAAATATTTTGCAGATTGGTTTCATC

AAAGGTCAGACCAGACCATTTTGCAAGTGATATATGATGATAATAAGCGC

CCCTCGGGTATCCCTGAAAGAATCTCTGGGTCCAGCTCAGGGACAACAGC

CACCTTGACCATCAGAGATGTCCGGGCTGAGGATGAAGGTGACTATTACT

GTTTCTCAGGATATGTTGATAGTGATAGCAAATTGTATGTTTTTGGCAGC

GGAACCCAGCTCACCGTCCTA

[Spacer (SEQ ID NO: 362)] [J43 MP014 2001 (SEQ ID NO: 1025)] Amino Acid Sequence:

(SEQ ID NO: 541)
[QGQSGQG][ANSCLAVEHKCKHNYGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL

J43 MP014 2001 Amino Acid Sequence:

(SEQ ID NO: 1090)
ANSCLAVEHKCKHNYGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP014 2001 (SEQ ID NO: 1026)] Nucleic Acid Sequence:

(SEQ ID NO: 542)
[CAAGGCCAGTCTGGCCAAGGT][GCTAATAGTTGCCTTGCTGTTGAGCA
TAAGTGCAAGCATAATTATGGAGGTGGCTCGAGCGGCGGCTCTATCTCTT
CCGGACTGCTGTCCGGCAGATCCGACAATCACGGCGGAGGCTCTTATGAG
CTGACTCAGCCACCTTCAGCATCAGTCAATGTAGGAGAGACTGTCAAAAT
CACCTGCTCTGGGGACCAATTGCCGAAATATTTTGCAGATTGGTTTCATC
AAAGGTCAGACCAGACCATTTTGCAAGTGATATATGATGATAATAAGCGC
CCCTCGGGTATCCCTGAAAGAATCTCTGGGTCCAGCTCAGGGACAACAGC
CACCTTGACCATCAGAGATGTCCGGGCTGAGGATGAAGGTGACTATTACT
GTTTCTCAGGATATGTTGATAGTGATAGCAAATTGTATGTTTTTGGCAGC
GGAACCCAGCTCACCGTCCTA

Reformatted Anti-Mouse PD-1 Heavy and Light Chains:
J43v2 light chain (LC) Amino Acid Sequence:

(SEQ ID NO: 543)
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL

J43v2 LC nucleotide sequence 1:

(SEQ ID NO: 544)
TATGAGCTGACTCAGCCACCTTCAGCATCAGTCAATGTAGGAGAGACTGT
CAAAATCACCTGCTCTGGGGACCAATTGCCGAAATATTTTGCAGATTGGT
TTCATCAAAGGTCAGACCAGACCATTTTGCAAGTGATATATGATGATAAT
AAGCGCCCCTCGGGTATCCCTGAAAGAATCTCTGGGTCCAGCTCAGGGAC
AACAGCCACCTTGACCATCAGAGATGTCCGGGCTGAGGATGAAGGTGACT
ATTACTGTTTCTCAGGATATGTTGATAGTGATAGCAAATTGTATGTTTTT
GGCAGCGGAACCCAGCTCACCGTCCTAGGTGGACCCAAGTCTTCTCCCAA
AGTCACAGTGTTTCCACCTTCACCTGAGGAGCTCCGGACAAACAAGCCA
CACTGGTGTGTCTGGTTAATGACTTCTACCCGGGTTCTGCAACAGTGACC
TGGAAGGCAAATGGAGCAACTATCAATGATGGGGTGAAGACTACAAAGCC
TTCCAAACAGGGCCAAAACTACATGACCAGCAGCTACCTAAGTTTGACAG
CAGACCAGTGGAAATCTCACAACAGGGTTTCCTGCCAAGTTACCCATGAA
GGGGAAACTGTGGAGAAGAGTTTGTCCCCTGCAGAATGTCTT

J43v2 LC nucleotide sequence 2:

(SEQ ID NO: 545)
TACGAGCTGACCCAGCCTCCTAGCGCCTCCGTGAATGTGGGCGAGACAGT
GAAGATCACCTGTAGCGGCGACCAGCTGCCCAAGTACTTCGCCGACTGGT
TCCACCAGCGGAGCGACCAGACAATCCTGCAAGTGATCTACGACGACAAC
AAGCGGCCCAGCGGCATCCCCGAGAGAATCAGCGGAAGCAGCAGCGGCAC
CACCGCCACCCTGACCATTAGAGATGTGCGGGCCGAGGACGAGGGCGACT
ACTACTGCTTTAGCGGCTACGTGGACAGCGACAGCAAGCTGTACGTGTTC
GGCTCCGGTACCCAGCTGACAGTGCTGGGCGGACCTAAGAGCAGCCCCAA
AGTGACCGTGTTCCCCCCAAGCCCCGAGGAACTGAGGACCAACAAGGCCA
CCCTCGTGTGCCTCGTGAACGACTTCTACCCTGGCAGCGCCACCGTGACC
TGGAAAGCCAATGGCGCCACCATCAACGACGGCGTGAAAACCACCAAGCC
CAGCAAGCAGGGCCAGAACTACATGACCAGCAGCTACCTGAGCCTGACCG
CCGACCAGTGGAAGTCCCACAACAGAGTGTCCTGCCAAGTGACCCACGAG
GGGGAAACCGTGGAAAAGAGCCTGAGCCCTGCCGAGTGCCTG

J43v2 mIgG2a heavy chain (HC) Amino Acid Sequence:

(SEQ ID NO: 546)
EVRLLESGGGLVKPEGSLKLSCVASGFTFSDYFMSWVRQAPGKGLEWVAH
IYTKSYNYATYYSGSVKGRFTISRDDSRSMVYLQMNNLRTEDTATYYCTR
DGSGYPSLDFWGQGTQVTVSSAKTTAPSVYPLAPVCGDTTGSSVTLGCLV
KGYFPEPVTLTWNSGSLSSGVHTFPAVLQSDLYTLSSSVTVTSSTWPSQS
ITCNVAHPASSTKVDKKIEPRGPTIKPCPPCKCPAPNLLGGPSVFIFPPK

-continued
IKDVLMISLSPIVTCVVVDVSEDDPDVQISWFVNNVEVHTAQTQTHREDY

NSTLRVVSALPIQHQDWMSGKEFKCKVNNKDLPAPIERTISKPKGSVRAP

QVYVLPPPEEEMTKKQVTLTCMVTDFMPEDIYVEWTNNGKTELNYKNTEP

VLDSDGSYFMYSKLRVEKKNWVERNSYSCSVVHEGLHNHHTTKSFSRTPG

K

J43v2 mIgG2a HC Nucleic Acid Sequence:

(SEQ ID NO: 547)
GAGGTGCGGCTTCTGGAGTCTGGTGGAGGATTAGTGAAGCCTGAGGGGTC

ACTGAAACTCTCCTGTGTGGCCTCTGGATTCACCTTCAGTGACTATTTCA

TGAGCTGGGTCCGCCAGGCTCCAGGGAAGGGGCTGGAGTGGGTTGCTCAC

ATATACACGAAAAGTTATAATTATGCAACTTATTACTCGGGTTCGGTGAA

AGGCAGATTCACCATCTCCAGAGATGATTCCCGAAGCATGGTCTACCTGC

AAATGAACAACCTGAGAACTGAGGACACGGCCACTTATTACTGTACAAGA

GATGGAAGCGGATATCCCTCTCTGGATTTCTGGGGTCAAGGGACCCAAGT

CACTGTCTCCTCAGCTAAAACAACAGCCCCATCGGTCTATCCACTGGCCC

CTGTGTGTGGAGATACAACTGGCTCCTCGGTGACTCTAGGATGCCTGGTC

AAGGGTTATTTCCCTGAGCCAGTGACCTTGACCTGGAACTCTGGATCCCT

GTCCAGTGGTGTGCACACCTTCCCAGCTGTCCTGCAGTCTGACCTCTACA

CCCTCAGCAGCTCAGTGACTGTAACCTCGAGCACCTGGCCCAGCCAGTCC

ATCACCTGCAATGTGGCCCACCCGGCAAGCAGCACCAAGGTGGACAAGAA

AATTGAGCCCAGAGGGCCCACAATCAAGCCCTGTCCTCCATGCAAATGCC

CAGCACCTAACCTCTTGGGTGGACCATCCGTCTTCATCTTCCCTCCAAAG

ATCAAGGATGTACTCATGATCTCCCTGAGCCCCATAGTCACATGTGTGGT

GGTGGATGTGAGCGAGGATGACCCAGATGTCCAGATCAGCTGGTTTGTGA

ACAACGTGGAAGTACACACAGCTCAGACACAAACCCATAGAGAGGATTAC

AACAGTACTCTCCGGGTGGTCAGTGCCCTCCCCATCCAGCACCAGGACTG

GATGAGTGGCAAGGAGTTCAAATGCAAGGTCAACAACAAAGACCTCCCAG

CGCCCATCGAGAGAACCATCTCAAAACCCAAAGGGTCAGTAAGAGCTCCA

CAGGTATATGTCTTGCCTCCACCAGAAGAAGAGATGACTAAGAAACAGGT

CACTCTGACCTGCATGGTCACAGACTTCATGCCTGAAGACATTTACGTGG

AGTGGACCAACAACGGGAAAACAGAGCTAAACTACAAGAACACTGAACCA

GTCCTGGACTCTGATGGTTCTTACTTCATGTACAGCAAGCTGAGAGTGGA

AAAGAAGAACTGGGTGGAAAGAAATAGCTACTCCTGTTCAGTGGTCCACG

AGGGTCTGCACAATCACCACACGACTAAGAGCTTCTCCCGGACTCCGGGT

AAA

Example 16: Activatable Anti-mPD-1 Antibodies with a Range of Masking Efficiencies This example describes the modulation of anti-mPD-1 antibody masking efficiencies by masking moiety truncation and single amino-acid substitution.

Figure 23:
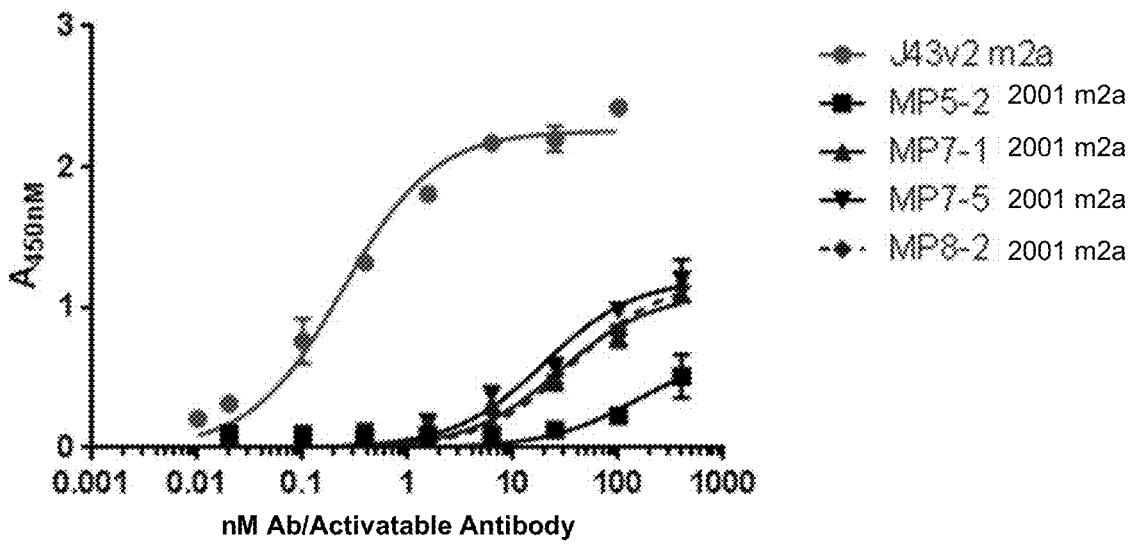
FIG. 23 is a graph depicting the binding to hPD-1 by the anti-PD-1 antibody J43v2 m2a and by various activatable anti-PD-1 antibodies that include the anti-PD-1 antibody J43v2 m2a, the cleavable moiety referred to herein as 2001, and the masking moieties referred to herein as MP5-2 (SEQ ID NO: 565), MP7-1 (SEQ ID NO: 558), MP7-5 (SEQ ID NO: 562), MP8-2 (SEQ ID NO: 549) (upper panel); and MP7-1 (SEQ ID NO: 558), MP8-9 (SEQ ID NO: 556), MP8-8 (SEQ ID NO: 555) (lower panel).
Figure 23:
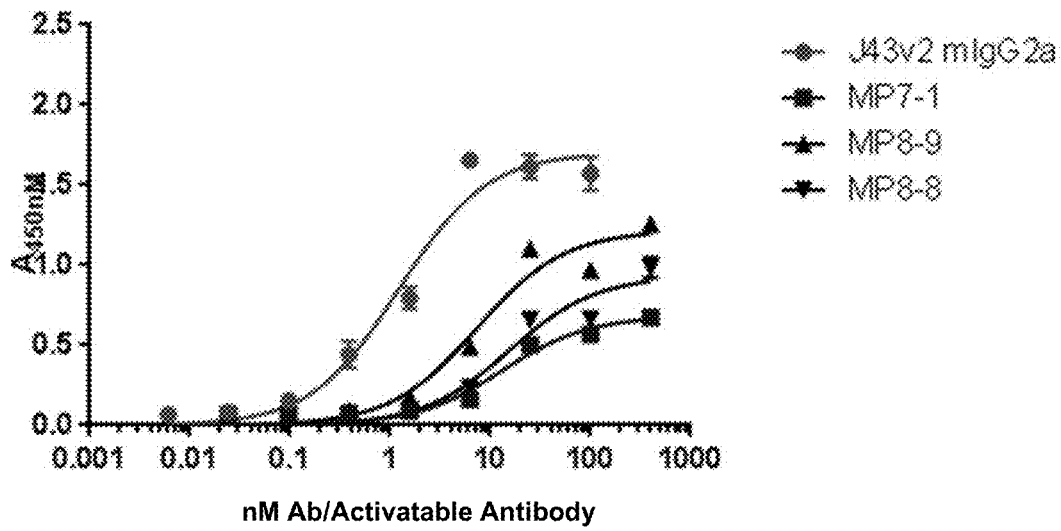

Four J43 activatable antibodies were selected to generate families of activatable anti-mPD-1 antibodies by masking moiety truncation or amino acid substitution of one or more MM residues. Table 18 lists the designed MMs. Activatable J43v2 antibodies with the designed MM and 2001 substrate were produced by transfection of 30 mL HEK293 cells and selected activatable antibodies (sequences MPtrunc ELISA activatable antibody LCs) were evaluated for masking by ELISA as described in Example 15 (FIG. 23).

In some embodiments, the activatable antibody also includes a spacer sequence. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. In some embodiments, the spacer joined directly to the N-terminus of MM of the activatable antibody is selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. In some embodiments, the spacer includes at least the amino acid sequence QGQSGQG (SEQ ID NO: 362). In some embodiments, the spacer includes at least the amino acid sequence QGQSGQ (SEQ ID NO: 913). In some embodiments, the spacer includes at least the amino acid sequence QGQSG (SEQ ID NO: 914). In some embodiments, the spacer includes at least the amino acid sequence QGQS (SEQ ID NO: 915). In some embodiments, the spacer includes at least the amino acid sequence QGQ (SEQ ID NO: 916). In some embodiments, the spacer includes at least the amino acid sequence QG (SEQ ID NO: 917). In some embodiments, the spacer includes at least the amino acid residue Q. In some embodiments, the activatable antibody does not include a spacer sequence.

While the sequences shown below include the spacer sequence of SEQ ID NO: 362, those of ordinary skill in the art appreciate that the activatable anti-PD-1 antibodies of the disclosure can include any suitable spacer sequence, such as, for example, a spacer sequence selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. While the sequences shown below include the spacer sequence of SEQ ID NO: 362, those of ordinary skill in the art will also appreciate that activatable anti-PD-1 antibodies of the disclosure in some embodiments do not include a spacer sequence.

TABLE 18

Masking moiety sequences

| Mask | Amino Acid Sequence | SEQ ID NO: |
|---|---|---|
| MP8-1 | QDHPKTKWNS | 548 |
| MP8-2 | ACRICQDHPATKWNS | 549 |
| MP8-3 | ACRICQDHPKTAWNS | 550 |
| MP8-4 | ACRICQDAPKTKWNS | 551 |
| MP8-5 | ACRICQDHAKTKWNS | 552 |
| MP8-6 | DHPATKWNS | 553 |
| MP8-7 | DHPKTAWNS | 554 |
| MP8-8 | DAPKTKWNS | 555 |
| MP8-9 | DAPATKWNS | 556 |
| MP8-10 | ACRICQDHP | 557 |

TABLE 18-continued

Masking moiety sequences

| Mask | Amino Acid Sequence | SEQ ID NO: |
|---|---|---|
| MP7-1 | HPQSKDTL | 558 |
| MP7-2 | HPKSQDTL | 559 |
| MP7-3 | TIPRCGQHPLCLDTL | 560 |
| MP7-4 | HPLSLDTL | 561 |
| MP7-5 | HPASKDTL | 562 |
| MP7-6 | HPKSADTL | 563 |
| MP5-1 | PGNCHPLQKELCQFI | 564 |
| MP5-2 | HPLQKELAQFI | 565 |
| MP5-3 | HPLALELAQFI | 566 |
| MP5-4 | PGNCHPLQLELCQFI | 567 |
| MP3-1 | TNIWSCQTYCDHAHA | 568 |
| MP3-2 | TNIWSCQTYCDHAHL | 569 |
| MP3-3 | TNIWSCQTYCDHLHA | 570 |
| MP3-4 | TNIWSCQTYCDHKHA | 571 |

[Spacer (SEQ ID NO: 362)] [J43 MP5-2 2001 (SEQ ID NO: 1027)] Amino Acid Sequence:

(SEQ ID NO: 572)
[QGQSGQG][HPLQKELAQFIGGGSSGGSISSGLLSGRSDNHGGGSYE
LTQPPSASVNVGETVKITCSGDQLPKYFADWFHQRSDQTILQVIYDDNK
RPSGIPERISGSSSGTTATLTIRDVRAEDEGDYYCFSGYVDSDSKLYV
FGSGTQLTVL]

J43 MP5-2 2001 Amino Acid Sequence:

(SEQ ID NO: 1113)
HPLQKELAQFIGGGSSGGSISSGLLSGRSDNHGGGSYELTQPPSASVNVG
ETVKITCSGDQLPKYFADWFHQRSDQTILQVIYDDNKRPSGIPERISGSS
SGTTATLTIRDVRAEDEGDYYCFSGYVDSDSKLYVFGSGTQLTVL

[Spacer (SEQ ID NO: 918)] [J43 MP5-2 2001 (SEQ ID NO: 1038)] Nucleic Acid Sequence:

(SEQ ID NO: 573)
[CAAGGCCAGTCTGGCCAAGGT][CATCCTCTGCAGAAGGAGCTGGCCCA
GTTTATTGGAGGTGGCTCGAGCGGCGGCTCTATCTCTTCCGGACTGCTGT
CCGGCAGATCCGACAATCACGGCGGAGGCTCTTACGAGCTGACCCAGCCT
CCTAGCGCCTCCGTGAATGTGGGCGAGACAGTGAAGATCACCTGTAGCGG
CGACCAGCTGCCCAAGTACTTCGCCGACTGGTTCCACCAGCGGAGCGACC
AGACAATCCTGCAAGTGATCTACGACGACAACAAGCGGCCCAGCGGCATC
CCCGAGAGAATCAGCGGAAGCAGCAGCGGCACCACCGCCACCCTGACCAT
TAGAGATGTGCGGGCCGAGGACGAGGGCGACTACTACTGCTTTAGCGGCT
ACGTGGACAGCGACAGCAAGCTGTACGTGTTCGGCTCCGGTACCCAGCTG

ACAGTGCTGGGCGGACCTAAGAGCAGCCCCAAAGTGACCGTGTTCCCCCC

AAGCCCCGAGGAACTGAGGACCAACAAGGCCACCCTCGTGTGCCTCGTGA

ACGACTTCTACCCTGGCAGCGCCACCGTGACCTGGAAAGCCAATGGCGCC

ACCATCAACGACGGCGTGAAAACCACCAAGCCCAGCAAGCAGGGCCAGAA

CTACATGACCAGCAGCTACCTGAGCCTGACCGCCGACCAGTGGAAGTCCC

ACAACAGAGTGTCCTGCCAAGTGACCCACGAGGGGGAAACCGTGGAAAAG

AGCCTGAGCCCTGCCGAGTGCCTG

[Spacer (SEQ ID NO: 362)] [J43 MP7-1 2001 (SEQ ID NO: 1039)] Amino Acid Sequence:

(SEQ ID NO: 574)
[QGQSGQG][HPQSKDTLGGGSSGGSISSGLLSGRSDNHGGGSYELTQPP
SASVNVGETVKITCSGDQLPKYFADWFHQRSDQTILQVIYDDNKRPSGIP
ERISGSSSGTTATLTIRDVRAEDEGDYYCFSGYVDSDSKLYVFGSGTQLT
VL]

J43 MP7-1 2001 Amino Acid Sequence:

(SEQ ID NO: 1114)
HPQSKDTLGGGSSGGSISSGLLSGRSDNHGGGSYELTQPPSASVNVGETV
KITCSGDQLPKYFADWFHQRSDQTILQVIYDDNKRPSGIPERISGSSSGT
TATLTIRDVRAEDEGDYYCFSGYVDSDSKLYVFGSGTQLTVL

[Spacer (SEQ ID NO: 918)] [J43 MP7-1 2001 (SEQ ID NO: 2062 Nucleic Acid Sequence:

(SEQ ID NO: 575)
[CAAGGCCAGTCTGGCCAAGGT][CATCCGCAGTCTAAGGATACTTTGGG
AGGTGGCTCGAGCGGCGGCTCTATCTCTTCCGGACTGCTGTCCGGCAGAT
CCGACAATCACGGCGGAGGCTCTTACGAGCTGACCCAGCCTCCTAGCGCC
TCCGTGAATGTGGGCGAGACAGTGAAGATCACCTGTAGCGGCGACCAGCT
GCCCAAGTACTTCGCCGACTGGTTCCACCAGCGGAGCGACCAGACAATCC
TGCAAGTGATCTACGACGACAACAAGCGGCCCAGCGGCATCCCCGAGAGA
ATCAGCGGAAGCAGCAGCGGCACCACCGCCACCCTGACCATTAGAGATGT
GCGGGCCGAGGACGAGGGCGACTACTACTGCTTTAGCGGCTACGTGGACA
GCGACAGCAAGCTGTACGTGTTCGGCTCCGGTACCCAGCTGACAGTGCTG
GGCGGACCTAAGAGCAGCCCCAAAGTGACCGTGTTCCCCCCAAGCCCCGA
GGAACTGAGGACCAACAAGGCCACCCTCGTGTGCCTCGTGAACGACTTCT
ACCCTGGCAGCGCCACCGTGACCTGGAAAGCCAATGGCGCCACCATCAAC
GACGGCGTGAAAACCACCAAGCCCAGCAAGCAGGGCCAGAACTACATGAC
CAGCAGCTACCTGAGCCTGACCGCCGACCAGTGGAAGTCCCACAACAGAG
TGTCCTGCCAAGTGACCCACGAGGGGGAAACCGTGGAAAAGAGCCTGAGC
CCTGCCGAGTGCCTG

MPtrunc ELISA Activatable Antibody LCs:

[Spacer (SEQ ID NO: 362)] [J43 MP7-5 2001 (SEQ ID NO: 1115)] Amino Acid Sequence:

(SEQ ID NO: 576)
[QGQSGQG][HPASKDTLGGGSSGGSISSGLLSGRSDNHGGGSYELTQPP

SASVNVGETVKITCSGDQLPKYFADWFHQRSDQTILQVIYDDNKRPSGIP

ERISGSSSGTTATLTIRDVRAEDEGDYYCFSGYVDSDSKLYVFGSGTQLT

VL]

J43 MP7-5 2001 Amino Acid Sequence:

(SEQ ID NO: 1115)
HPASKDTLGGGSSGGSISSGLLSGRSDNHGGGSYELTQPPSASVNVGETV

KITCSGDQLPKYFADWFHQRSDQTILQVIYDDNKRPSGIPERISGSSSGT

TATLTIRDVRAEDEGDYYCFSGYVDSDSKLYVFGSGTQLTVL

[Spacer (SEQ ID NO: 918)] [J43 MP7-5 2001 (SEQ ID NO: 2061] Nucleic Acid Sequence:

(SEQ ID NO: 577)
[CAAGGCCAGTCTGGCCAAGGT][CATCCGGCGTCTAAGGATACTTTGGG

AGGTGGCTCGAGCGGCGGCTCTATCTCTTCCGGACTGCTGTCCGGCAGAT

CCGACAATCACGGCGGAGGCTCTTACGAGCTGACCCAGCCTCCTAGCGCC

TCCGTGAATGTGGGCGAGACAGTGAAGATCACCTGTAGCGGCGACCAGCT

GCCCAAGTACTTCGCCGACTGGTTCCACCAGCGGAGCGACCAGACAATCC

TGCAAGTGATCTACGACGACAACAAGCGGCCCAGCGGCATCCCCGAGAGA

ATCAGCGGAAGCAGCAGCGGCACCACCGCCACCCTGACCATTAGAGATGT

GCGGGCCGAGGACGAGGGCGACTACTACTGCTTTAGCGGCTACGTGGACA

GCGACAGCAAGCTGTACGTGTTCGGCTCCGGTACCCAGCTGACAGTGCTG

GGCGGACCTAAGAGCAGCCCCAAAGTGACCGTGTTCCCCCCAAGCCCCGA

GGAACTGAGGACCAACAAGGCCACCCTCGTGTGCCTCGTGAACGACTTCT

ACCCTGGCAGCGCCACCGTGACCTGGAAAGCCAATGGCGCCACCATCAAC

GACGGCGTGAAAACCACCAAGCCCAGCAAGCAGGGCCAGAACTACATGAC

CAGCAGCTACCTGAGCCTGACCGCCGACCAGTGGAAGTCCCACAACAGAG

TGTCCTGCCAAGTGACCCACGAGGGGAAACCGTGGAAAAGAGCCTGAGC

CCTGCCGAGTGCCTG

[Spacer (SEQ ID NO: 362)] [J43 MP8-2 2001 (SEQ ID NO: 1032)] Amino Acid Sequence:

(SEQ ID NO: 578)
[QGQSGQG][ACRICQDHPATKWNSGGGSSGGSISSGLLSGRSDNHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVL]

J43 MP8-2 2001 Amino Acid Sequence:

(SEQ ID NO: 1116)
ACRICQDHPATKWNSGGGSSGGSISSGLLSGRSDNHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVL

[Spacer (SEQ ID NO: 918)] J43 MP8-2 2001 (SEQ ID NO: 1033)] Nucleic Acid Sequence:

(SEQ ID NO: 579)
[CAAGGCCAGTCTGGCCAAGGT][GCGTGCCGTATTTGTCAGGATCATCC

TGCGACGAAGTGGAATTCTGGAGGTGGCTCGAGCGGCGGCTCTATCTCTT

CCGGACTGCTGTCCGGCAGATCCGACAATCACGGCGGAGGCTCTACGAGC

TGACCCAGCCTCCTAGCGCCTCCGTGAATGTGGGCGAGACAGTGAAGATC

ACCTGTAGCGGCGACCAGCTGCCCAAGTACTTCGCCGACTGGTTCCACCA

GCGGAGCGACCAGACAATCCTGCAAGTGATCTACGACGACAACAAGCGGC

CCAGCGGCATCCCCGAGAGAATCAGCGGAAGCAGCAGCGGCACCACCGCC

ACCCTGACCATTAGAGATGTGCGGGCCGAGGACGAGGGCGACTACTACTG

CTTTAGCGGCTACGTGGACAGCGACAGCAAGCTGTACGTGTTCGGCTCCG

GTACCCAGCTGACAGTGCTGGGCGGACCTAAGAGCAGCCCCAAAGTGACC

GTGTTCCCCCCAAGCCCCGAGGAACTGAGGACCAACAAGGCCACCCTCGT

GTGCCTCGTGAACGACTTCTACCCTGGCAGCGCCACCGTGACCTGGAAAG

CCAATGGCGCCACCATCAACGACGGCGTGAAAACCACCAAGCCCAGCAAG

CAGGGCCAGAACTACATGACCAGCAGCTACCTGAGCCTGACCGCCGACCA

GTGGAAGTCCCACAACAGAGTGTCCTGCCAAGTGACCCACGAGGGGAAA

CCGTGGAAAAGAGCCTGAGCCCTGCCGAGTGCCTG

[Spacer (SEQ ID NO: 362)] [J43 MP8-8 2001 (SEQ ID NO: 1034)] Amino Acid Sequence:

(SEQ ID NO: 580)
[QGQSGQG][DAPKTKWNSGGGSSGGSISSGLLSGRSDNHGGGSYELTQP

PSASVNVGETVKITCSGDQLPKYFADWFHQRSDQTILQVIYDDNKRPSGI

PERISGSSSGTTATLTIRDVRAEDEGDYYCFSGYVDSDSKLYVFGSGTQL

TVL]

J43 MP8-8 2001 Amino Acid Sequence:

(SEQ ID NO: 1117)
DAPKTKWNSGGGSSGGSISSGLLSGRSDNHGGGSYELTQPPSASVNVGET

VKITCSGDQLPKYFADWFHQRSDQTILQVIYDDNKRPSGIPERISGSSSG

TTATLTIRDVRAEDEGDYYCFSGYVDSDSKLYVFGSGTQLTVL

[Spacer (SEQ ID NO: 918)] J43 MP8-8 2001 (SEQ ID NO: 1035)] Nucleic Acid Sequence:

(SEQ ID NO: 581)
[CAAGGCCAGTCTGGCCAAGGT][GATGCTCCTAAGACGAAGTGGAATTC

TGGAGGTGGCTCGAGCGGCGGCTCTATCTCTTCCGGACTGCTGTCCGGCA

-continued
GATCCGACAATCACGGCGGAGGCTCTTACGAGCTGACCCAGCCTCCTAGC
GCCTCCGTGAATGTGGGCGAGACAGTGAAGATCACCTGTAGCGGCGACCA
GCTGCCCAAGTACTTCGCCGACTGGTTCCACCAGCGGAGCGACCAGACAA
TCCTGCAAGTGATCTACGACGACAACAAGCGGCCCAGCGGCATCCCCGAG
AGAATCAGCGGAAGCAGCAGCGGCACCACCGCCACCCTGACCATTAGAGA
TGTGCGGGCCGAGGACGAGGGCGACTACTACTGCTTTAGCGGCTACGTGG
ACAGCGACAGCAAGCTGTACGTGTTCGGCTCCGGTACCCAGCTGACAGTG
CTGGGCGGACCTAAGAGCAGCCCCAAAGTGACCGTGTTCCCCCCAAGCCC
CGAGGAACTGAGGACCAACAAGGCCACCCTCGTGTGCCTCGTGAACGACT
TCTACCCTGGCAGCGCCACCGTGACCTGGAAAGCCAATGGCGCCACCATC
AACGACGGCGTGAAAACCACCAAGCCCAGCAAGCAGGGCCAGAACTACAT
GACCAGCAGCTACCTGAGCCTGACCGCCGACCAGTGGAAGTCCCACAACA
GAGTGTCCTGCCAAGTGACCCACGAGGGGGAAACCGTGGAAAAGAGCCTG
AGCCCTGCCGAGTGCCTG

[Spacer (SEQ ID NO: 362)] [J43 MP8-9 2001 (SEQ ID NO: 1036)] Amino Acid Sequence:

(SEQ ID NO: 582)
[QGQSGQG][DAPATKWNSGGGSSGGSISSGLLSGRSDNHGGGSYELTQP
PSASVNVGETVKITCSGDQLPKYFADWFHQRSDQTILQVIYDDNKRPSGI
PERISGSSSGTTATLTIRDVRAEDEGDYYCFSGYVDSDSKLYVFGSGTQL
TVL]

J43 MP8-9 2001 Amino Acid Sequence:

(SEQ ID NO: 1118)
DAPATKWNSGGGSSGGSISSGLLSGRSDNHGGGSYELTQPPSASVNVGET
VKITCSGDQLPKYFADWFHQRSDQTILQVIYDDNKRPSGIPERISGSSSG
TTATLTIRDVRAEDEGDYYCFSGYVDSDSKLYVFGSGTQLTVL

[Spacer (SEQ ID NO: 918)] [J43 MP8-9 2001 (SEQ ID NO: 1037)] Nucleic Acid Sequence:

(SEQ ID NO: 583)
[CAAGGCCAGTCTGGCCAAGGT][GATGCTCCTGCGACGAAGTGGAATTC
TGGAGGTGGCTCGAGCGGCGGCTCTATCTCTTCCGGACTGCTGTCCGGCA
GATCCGACAATCACGGCGGAGGCTCTTACGAGCTGACCCAGCCTCCTAGC
GCCTCCGTGAATGTGGGCGAGACAGTGAAGATCACCTGTAGCGGCGACCA
GCTGCCCAAGTACTTCGCCGACTGGTTCCACCAGCGGAGCGACCAGACAA
TCCTGCAAGTGATCTACGACGACAACAAGCGGCCCAGCGGCATCCCCGAG
AGAATCAGCGGAAGCAGCAGCGGCACCACCGCCACCCTGACCATTAGAGA
TGTGCGGGCCGAGGACGAGGGCGACTACTACTGCTTTAGCGGCTACGTGG
ACAGCGACAGCAAGCTGTACGTGTTCGGCTCCGGTACCCAGCTGACAGTG
CTGGGCGGACCTAAGAGCAGCCCCAAAGTGACCGTGTTCCCCCCAAGCCC
CGAGGAACTGAGGACCAACAAGGCCACCCTCGTGTGCCTCGTGAACGACT
TCTACCCTGGCAGCGCCACCGTGACCTGGAAAGCCAATGGCGCCACCATC
AACGACGGCGTGAAAACCACCAAGCCCAGCAAGCAGGGCCAGAACTACAT
GACCAGCAGCTACCTGAGCCTGACCGCCGACCAGTGGAAGTCCCACAACA
GAGTGTCCTGCCAAGTGACCCACGAGGGGGAAACCGTGGAAAAGAGCCTG
AGCCCTGCCGAGTGCCTG

[Spacer (SEQ ID NO: 362)] [J43 MP8-2 2003 (SEQ ID NO: 1119) Amino Acid Sequence:

(SEQ ID NO: 1120)
[QGQSGQG][ACRICQDHPATKWNSGGGSSGGSISSGLLSGRSANPRGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP8-2 2003 Amino Acid Sequence:

(SEQ ID NO: 1119)
ACRICQDHPATKWNSGGGSSGGSISSGLLSGRSANPRGGGSYELTQPPSA
SVNVGETVKITCSGDQLPKYFADWFHQRSDQTILQVIYDDNKRPSGIPER
ISGSSSGTTATLTIRDVRAEDEGDYYCFSGYVDSDSKLYVFGSGTQLTVL

[Spacer (SEQ ID NO: 918)] [J43 MP8-2 2003 (SEQ ID NO: 1121) Nucleotide Sequence:

(SEQ ID NO: 1122)
[CAAGGCCAGTCTGGCCAAGGT][GCGTGCCGTATTTGTCAGGATCATCC
TGCGACGAAGTGGAATTCTGGAGGTGGCTCGAGCGGCGGCTCTATCTCTT
CCGGACTGCTGTCCGGCAGATCCGCCAATCCTCGTGGCGGAGGATCCTAC
GAGCTGACCCAGCCTCCTAGCGCCTCCGTGAATGTGGGCGAGACAGTGAA
GATCACCTGTAGCGGCGACCAGCTGCCCAAGTACTTCGCCGACTGGTTCC
ACCAGCGGAGCGACCAGACAATCCTGCAAGTGATCTACGACGACAACAAG
CGGCCCAGCGGCATCCCCGAGAGAATCAGCGGAAGCAGCAGCGGCACCAC
CGCCACCCTGACCATTAGAGATGTGCGGGCCGAGGACGAGGGCGACTACT
ACTGCTTTAGCGGCTACGTGGACAGCGACAGCAAGCTGTACGTGTTCGGC
TCCGGTACCCAGCTGACAGTGCTG]

[Spacer (SEQ ID NO: 362)] [J43 MP8-2 2005 (SEQ ID NO: 1123) Amino Acid Sequence:

(SEQ ID NO: 1124)
[QGQSGQG][ACRICQDHPATKWNSGGGSSGGAVGLLAPPSGRSANPRGG
GSYELTQPPSASVNVGETVKITCSGDQLPKYFADWFHQRSDQTILQVIYD
DNKRPSGIPERISGSSSGTTATLTIRDVRAEDEGDYYCFSGYVDSDSKLY
VFGSGTQLTVL]

J43 MP8-2 2005 Amino Acid Sequence:

(SEQ ID NO: 1123)
ACRICQDHPATKWNSGGGSSGGAVGLLAPPSGRSANPRGGGSYELTQPPS
ASVNVGETVKITCSGDQLPKYFADWFHQRSDQTILQVIYDDNKRPSGIPE

-continued
RISGSSSGTTATLTIRDVRAEDEGDYYCFSGYVDSDSKLYVFGSGTQLTV
L

[Spacer (SEQ ID NO: 362)] [J43 MP8-2 2008 (SEQ ID NO: 1127) Amino Acid Sequence:

(SEQ ID NO: 1128)
[QGQSGQG][ACRICQDHPATKWNSGGGSSGGSISSGLLSGRSDGHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVL]

J43 MP8-2 2008 Amino Acid Sequence:

(SEQ ID NO: 1127)
ACRICQDHPATKWNSGGGSSGGSISSGLLSGRSDGHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP8-2 2008 (SEQ ID NO: 1129) Nucleotide Sequence:

(SEQ ID NO: 1130)
[CAAGGCCAGTCTGGCCAAGGT][GCGTGCCGTATTTGTCAGGATCATCC
TGCGACGAAGTGGAATTCTGGAGGTGGCTCGAGCGGCGGCTCTATCTCTT
CCGGACTGCTGTCCGGCAGATCCGACCAGCACGGCGGAGGATCCTACGA
GCTGACCCAGCCTCCTAGCGCCTCCGTGAATGTGGGCGAGACAGTGAAG
ATCACCTGTAGCGGCGACCAGCTGCCCAAGTACTTCGCCGACTGGTTCC
ACCAGCGGAGCGACCAGACAATCCTGCAAGTGATCTACGACGACAACA
AGCGGCCCAGCGGCATCCCCGAGAGAATCAGCGGAAGCAGCAGCGGC
ACCACCGCCACCCTGACCATTAGAGATGTGCGGGCCGAGGACGAGGG
CGACTACTACTGCTTTAGCGGCTACGTGGACAGCGACAGCAAGCTGTAC
GTGTTCGGCTCCGGTACCCAGCTGACAGTGCTG]

[Spacer (SEQ ID NO: 362)] [J43 MP8-2 2012 (SEQ ID NO: 1131) Amino Acid Sequence:

(SEQ ID NO: 1132)
[QGQSGQG][ACRICQDHPATKWNSGGGSSGGSISSGLLSGRSANPGGG
SYELTQPPSASVNVGETVKITCSGDQLPKYFADWFHQRSDQTILQVIYDD
NKRPSGIPERISGSSSGTTATLTIRDVRAEDEGDYYCFSGYVDSDSKLYV
FGSGTQLTVL]

J43 MP8-2 2012 Amino Acid Sequence:

(SEQ ID NO: 1131)
ACRICQDHPATKWNSGGGSSGGSISSGLLSGRSANPGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP8-2 2012 (SEQ ID NO: 616) Nucleotide Sequence:

(SEQ ID NO: 1133)
[CAAGGCCAGTCTGGCCAAGGT][GCGTGCCGTATTTGTCAGGATCATC
CTGCGACGAAGTGGAATTCTGGAGGTGGCTCGAGCGGCGGCTCTATC
TCTTCCGGACTGCTGTCCGGCAGATCCGCTAATCCCGGCGGAGGA
TCCTACGAGCTGACCCAGCCTCCTAGCGCCTCCGTGAATGTGGGCGAGA
CAGTGAAGATCACCTGTAGCGGCGACCAGCTGCCCAAGTACTTCGCCGA
CTGGTTCCACCAGCGGAGCGACCAGACAATCCTGCAAGTGATCTACGAC
GACAACAAGCGGCCCAGCGGCATCCCCGAGAGAATCAGCGGAAGCAGCA
GCGGCACCACCGCCACCCTGACCATTAGAGATGTGCGGGCCGAGGACGA
GGGCGACTACTACTGCTTTAGCGGCTACGTGGACAGCGACAGCAAGCTG
TACGTGTTCGGCTCCGGTACCCAGCTGACAGTGCTG]

[Spacer (SEQ ID NO: 362)] [J43 MP8-2 2011 (SEQ ID NO: 1134) Amino Acid Sequence:

(SEQ ID NO: 1135)
[QGQSGQG][ACRICQDHPATKWNSGGGSSGGSISSGLLSGRSDNP
GGGSYELTQPPSASVNVGETVKITCSGDQLPKYFADWFHQRSDQTI
LQVIYDDNKRPSGIPERISGSSSGTTATLTIRDVRAEDEGDYYCFSGYV
DSDSKLYVFGSGTQLTVL]

J43 MP8-2 2011 Amino Acid Sequence:

(SEQ ID NO: 1134)
ACRICQDHPATKWNSGGGSSGGSISSGLLSGRSDNPGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVL

[Spacer (SEQ ID NO: 918)] [J43 MP8-2 2011 (SEQ ID NO: 1136) Nucleotide Sequence:

(SEQ ID NO: 1137)
[CAAGGCCAGTCTGGCCAAGGT][GCGTGCCGTATTTGTCAGGATCA
TCCTGCGACGAAGTGGAATTCTGGAGGTGGCTCGAGCGGCGGCTC
TATCTCTTCCGGACTGCTGTCCGGCAGATCCGACAATCCCGGCGGAGGA
TCCTACGAGCTGACCCAGCCTCCTAGCGCCTCCGTGAATGTGGGCGAGA
CAGTGAAGATCACCTGTAGCGGCGACCAGCTGCCCAAGTACTTCGCCGA
CTGGTTCCACCAGCGGAGCGACCAGACAATCCTGCAAGTGATCTACGAC
GACAACAAGCGGCCCAGCGGCATCCCCGAGAGAATCAGCGGAAGCAGCA
GCGGCACCACCGCCACCCTGACCATTAGAGATGTGCGGGCCGAGGACGA
GGGCGACTACTACTGCTTTAGCGGCTACGTGGACAGCGACAGCAAGCTG
TACGTGTTCGGCTCCGGTACCCAGCTGACAGTGCTG]

Example 17: Activatable Anti-Mouse PD-1 J43 Antibodies Reduce Incidence of Diabetes in NOD Mice In this Example, anti-PD-1 J43 activatable antibodies were analyzed for the ability to protect from anti-PD-1 induction of diabetes in NOD mice. The NOD mice, substrain NOD/ShiLtJ, were obtained from Jackson Laboratory at 8 weeks and acclimated on site for 2 weeks. At 10 weeks, mice were checked for diabetes prior to enrollment, grouped, and dosed as set forth in Table 4.

TABLE 4

Dosing regimen

| Group | Count | Gender | Treatment | Dose (mg/kg) | Dose volume (mL/kg) | Schedule | Route |
|---|---|---|---|---|---|---|---|
| 1 | 7 | F | mIgG2a (C1.18.4) | 10 | 10 | q7dx1 | IP |
| 2 | 7 | F | Anti-PD-1 J43 m2a | 10 | 10 | q7dx1 | IP |
| 3 | 7 | F | Anti-PD-1 J43 m2a | 3 | 10 | q7dx1 | IP |
| 4 | 7 | F | Anti-PD-1 J43 m2a | 1 | 10 | q7dx1 | IP |
| 5 | 7 | F | J43 MP7-1 2001 m2a | 10 | 10 | q7dx1 | IP |
| 6 | 7 | F | J43 MP7-1 2001 m2a | 3 | 10 | q7dx1 | IP |
| 7 | 7 | F | J43 MP8-2 2001 m2a | 10 | 10 | q7dx1 | IP |
| 8 | 7 | F | J43 MP8-2 2001 m2a | 3 | 10 | q7dx1 | IP |

Figure 24:
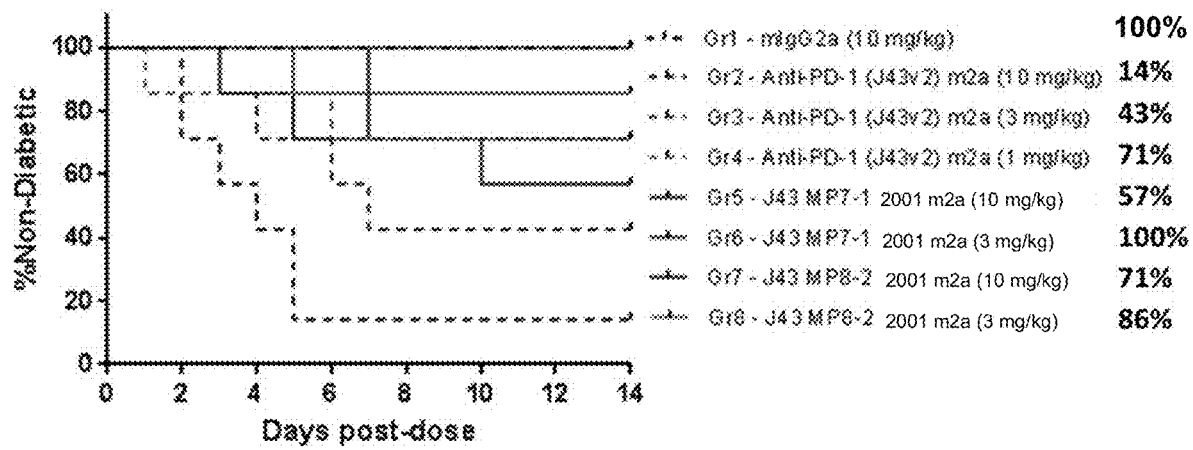
FIG. 24 is a graph depicting that the anti-PD-1 J43v2 antibody induced diabetes in NOD mice with increased frequency as dosage increased and that anti-PD-1 J43v2 activatable antibodies exhibited reduced diabetes compared to antibodies at similar doses.

FIG. 24 which plots % non-diabetic versus number of days post dose, shows that anti-PD-1 J43 antibody induced diabetes in NOD mice with increased frequency as dosage increased. At day fourteen post dose, the percentage of non-diabetic mice for the antibody-treated groups was 14%, 43% and 71% for the 20 mg/kg, 3 mg/kg and 1 mg/kg dose groups, respectively. Activatable antibodies J43 MP7-1 2001 m2a and J43 MP8-2 2001 m2a required increased doses to induce diabetes at frequencies comparable to the parental antibody. At day fourteen post dose with J43 MP7-1 2001 m2a, 57% of the 20 mg/kg group remained non-diabetic and all of the 3 mg/kg were non-diabetic. At day fourteen post dose with J43 MP8-2 2001 m2a, 71% of the 20 mg/kg group and 86% of the 3 mg/kg group remained non-diabetic.

Example 18: Evaluation of Efficiency of Masking Moieties

This example describes additional activatable anti-PD-1 antibodies that exhibit reduced binding to hPD-1.

Examples of additional activatable antibodies of the disclosure comprising anti-PD1 antibody A1.5 and a variety of mask and substrate combinations were produced using techniques as described herein. The amino acid and nucleic acid sequences of these activatable anti-PD-1 antibody variable domains of the disclosure are provided below. Antibodies were produced as hIgG4 containing a single amino acid substitution, S228P (Angal, et al. 1993. Mol Immunol 30:105-8.) HC and hK LC format.

Figure 25A:
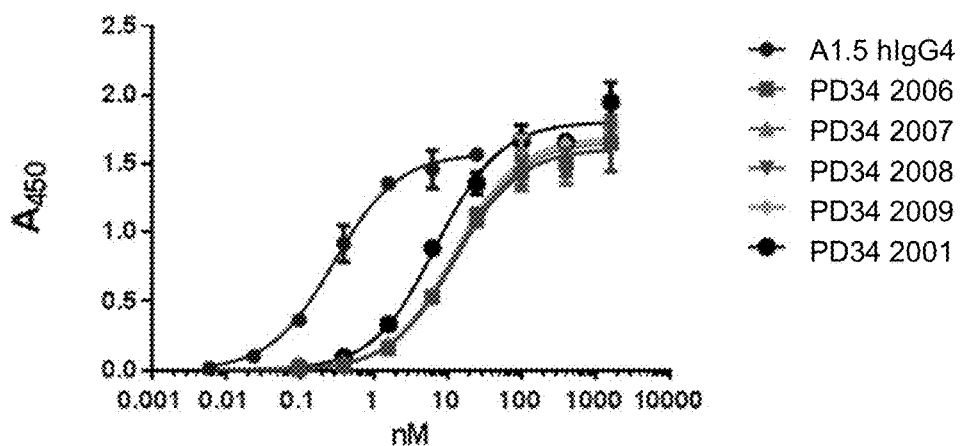
FIGS. 25A and 25B are a series of graphs depicting the binding to hPD-1 by the anti-PD-1 antibody A1.5 and by of various activatable antibodies of the disclosure comprising the anti-PD1 antibody A1.5, the masking moiety referred to herein as PD34 (SEQ ID NO: 99), and for FIG. 25A, the substrates referred to herein as 2006 (SEQ ID NO: 1095), 2007 (SEQ ID NO: 1096), 2008 (SEQ ID NO: 1097), 2009 (SEQ ID NO: 1098), and 2001 (SEQ ID NO: 214), and for FIG. 25B, the substrates referred to herein as 2001 (SEQ ID NO: 214), 2008 (SEQ ID NO: 1097), 2012 (SEQ ID NO: 1101), 2011 (SEQ ID NO: 1100), and 2003 (SEQ ID NO: 1092).
Figure 25B:
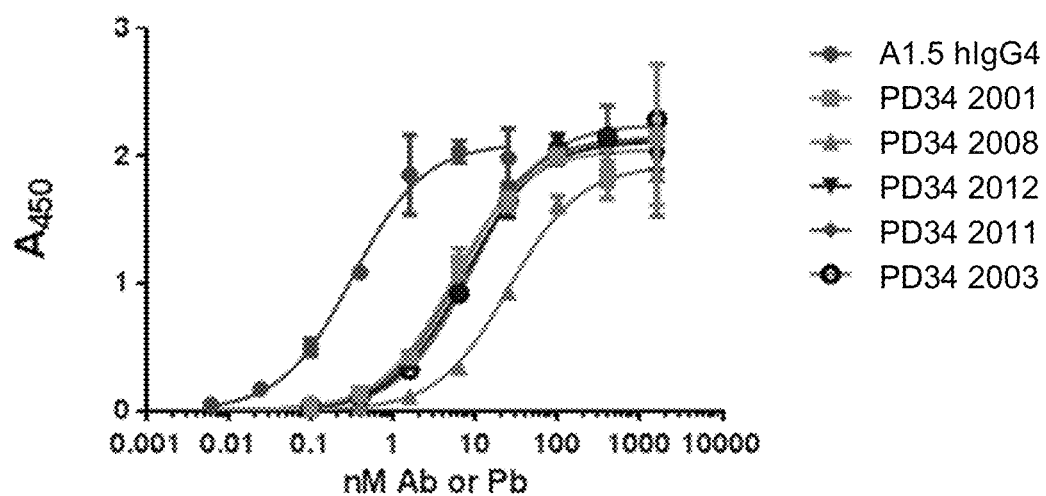

Masking efficiencies of several of these activatable antibodies were determined as described herein. The results are shown in FIGS. 25A and 25B.

In some embodiments, the activatable antibody also includes a spacer sequence. In some embodiments, the spacer is joined directly to the MM of the activatable antibody. In some embodiments, the spacer is joined directly to the MM of the activatable antibody in the structural arrangement from N-terminus to C-terminus of spacer-MM-CM-AB. In some embodiments, the spacer joined directly to the N-terminus of MM of the activatable antibody is selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. In some embodiments, the spacer includes at least the amino acid sequence QGQSGQG (SEQ ID NO: 362). In some embodiments, the spacer includes at least the amino acid sequence QGQSGQ (SEQ ID NO: 913). In some embodiments, the spacer includes at least the amino acid sequence QGQSG (SEQ ID NO: 914). In some embodiments, the spacer includes at least the amino acid sequence QGQS (SEQ ID NO: 915), In some embodiments, the spacer includes at least the amino acid sequence QGQ (SEQ ID NO: 916). In some embodiments, the spacer includes at least the amino acid sequence QG (SEQ ID NO: 917). In some embodiments, the spacer includes at least the amino acid residue Q. In some embodiments, the activatable antibody does not include a spacer sequence. Additional examples of spacers include GQSGQG (SEQ ID NO: 2042), QSGQG (SEQ ID NO: 2043), SGQG (SEQ ID NO: 2044), GQG (SEQ ID NO: 2045), QG (SEQ ID NO: 2046), and G.

While the sequences shown below include the spacer sequence of SEQ ID NO: 362, those of ordinary skill in the art appreciate that the activatable anti-PD-1 antibodies of the disclosure can include any suitable spacer sequence, such as, for example, a spacer sequence selected from the group consisting of QGQSGQG (SEQ ID NO: 362), QGQSGQ (SEQ ID NO: 913), QGQSG (SEQ ID NO: 914), QGQS (SEQ ID NO: 915), QGQ (SEQ ID NO: 916), QG (SEQ ID NO: 917), and Q. Additional examples of spacers include GQSGQG (SEQ ID NO: 2042), QSGQG (SEQ ID NO: 2043), SGQG (SEQ ID NO: 2044), GQG (SEQ ID NO: 2045), QG (SEQ ID NO: 2046), and G While the sequences shown below include the spacer sequence of SEQ ID NO: 362, those of ordinary skill in the art will also appreciate that activatable anti-PD-1 antibodies of the disclosure in some embodiments do not include a spacer sequence.

[Spacer (SEQ ID NO: 362)] [PD1 1.5 PD01 2003 (SEQ ID NO: 1138) Amino Acid Sequence:

(SEQ ID NO: 1139)
[QGQSGQG][AMSGCSWSAFCPYLAGGGSSGGSISSGLLSGRSANPR

GGGSDIQLTQSPSSLSASVGDRVTITCRASESVDAYGISFMNWFQ

QKPGKAPKLLIYAASNQGSGVPSRFSGSGSGTDFTLTISSMQPEDFATY

YCQQSKDVPWTFGQGTKLEIK]

PD1 1.5 PD01 2003 Amino Acid Sequence:

(SEQ ID NO: 1138)
AMSGCSWSAFCPYLAGGGSSGGSISSGLLSGRSANPRGGGSDIQLTQSPS

SLSASVGDRVTITCRASESVDAYGISFMNWFQQKPGKAPKLLIYAASNQG

-continued

SGVPSRFSGSGSGTDFTLTISSMQPEDFATYYCQQSKDVPWTFGQGTKLEIK

[Spacer (SEQ ID NO: 918)] [PD1 1.5 PD001 2003 (SEQ ID NO: 1141)] Nucleotide Sequence:

(SEQ ID NO: 1142)
[CAAGGCCAGTCTGGCCAAGGT][GCGATGAGTGGGTGCTCGTGGT
CTGCTTTTTGCCCGTATTTGGCGGGAGGTGGCTCGAGCGGCGGCTC
TATCTCTTCCGGACTGCTGTCCGGCAGATCCGCCAATCCTCGTGGCGGA
GGATCCGATATCCAGCTGACCCAGAGCCCTAGCAGCCTGTCTGCCAGCG
TGGGCGACAGAGTGACCATCACCTGTAGAGCCAGCGAGAGCGTGGACGC
TTACGGCATCAGCTTCATGAACTGGTTCCAGCAGAAGCCCGGCAAGGCC
CCCAAGCTGCTGATCTACGCCGCCAGCAATCAGGGCAGCGGCGTGCCAA
GCAGATTTTCCGGCTCTGGCAGCGGCACCGACTTCACCCTGACCATCAG
CAGCATGCAGCCCGAGGACTTCGCCACCTACTACTGCCAGCAGAGCAAG
GACGTGCCCTGGACCTTTGGCCAGGGTACCAAGCTGGAAATCAAG]

[Spacer (SEQ ID NO: 362)] [PD1 1.5 PD01 2012 (SEQ ID NO: 1144) Amino Acid Sequence:

(SEQ ID NO: 1143)
[QGQSGQG][AMSGCSWSAFCPYLGGGSSGGSISSGLLSGRSANPGG
GSDIQLTQSPSSLSASVGDRVTITCRASESVDAYGISFMNWFQQK
PGKAPKLLIYAASNQGSGVPSRFSGSGSGTDFTLTISSMQPEDFATYYC
QQSKDVPWTFGQGTKLEIK]

PD1 1.5 PD01 2012 Amino Acid Sequence:

(SEQ ID NO: 1144)
AMSGCSWSAFCPYLGGGSSGGSISSGLLSGRSANPGGGSDIQLTQSPSSL
SASVGDRVTITCRASESVDAYGISFMNWFQQKPGKAPKLLIYAASNQGSG
VPSRFSGSGSGTDFTLTISSMQPEDFATYYCQQSKDVPWTFGQGTKLEIK

[Spacer (SEQ ID NO: 918)] [PD1 1.5 PD01 2012 (SEQ ID NO: 1145)] Nucleotide Sequence:

(SEQ ID NO: 1146)
[CAAGGCCAGTCTGGCCAAGGT][GCGATGAGTGGGTGCTCGTGGTC
TGCTTTTTGCCCGTATTTGGCGGGAGGTGGCTCGAGCGGCGGCTC
TATCTCTTCCGGACTGCTGTCCGGCAGATCCGCTAATCCCGGCGGAGGA
TCCGATATCCAGCTGACCCAGAGCCCTAGCAGCCTGTCTGCCAGCGTGG
GCGACAGAGTGACCATCACCTGTAGAGCCAGCGAGAGCGTGGACGCTTA
CGGCATCAGCTTCATGAACTGGTTCCAGCAGAAGCCCGGCAAGGCCCCC
AAGCTGCTGATCTACGCCGCCAGCAATCAGGGCAGCGGCGTGCCAAGCA
GATTTTCCGGCTCTGGCAGCGGCACCGACTTCACCCTGACCATCAGCAG
CATGCAGCCCGAGGACTTCGCCACCTACTACTGCCAGCAGAGCAAGGAC
GTGCCCTGGACCTTTGGCCAGGGTACCAAGCTGGAAATCAAG]

[Spacer (SEQ ID NO: 362)] [PD1 1.5 PD01 2011 (SEQ ID NO: 1148) Amino Acid Sequence:

(SEQ ID NO: 1147)
[QGQSGQG][AMSGCSWSAFCPYLGGGSSGGSISSGLLSGRSDNPG
GGSDIQLTQSPSSLSASVGDRVTITCRASESVDAYGISFMNWFQQK
PGKAPKLLIYAASNQGSGVPSRFSGSGSGTDFTLTISSMQPEDFATYYC
QQSKDVPWTFGQGTKLEIK]

PD1 1.5 PD01 2011 Amino Acid Sequence:

(SEQ ID NO: 1148)
AMSGCSWSAFCPYLGGGSSGGSISSGLLSGRSDNPGGGSDIQLTQSPSSL
SASVGDRVTITCRASESVDAYGISFMNWFQQKPGKAPKLLIYAASNQGSG
VPSRFSGSGSGTDFTLTISSMQPEDFATYYCQQSKDVPWTFGQGTKLEIK

[Spacer (SEQ ID NO: 918)] [PD1 1.5 PD01 2011 (SEQ ID NO: 1149)] Nucleotide Sequence:

(SEQ ID NO: 1150)
[CAAGGCCAGTCTGGCCAAGGT][GCGATGAGTGGGTGCTCGTGGTCTGC
TTTTTGCCCGTATTTGGCGGGAGGTGGCTCGAGCGGCGGCTCTATCTCTT
CCGGACTGCTGTCCGGCAGATCCGACAATCCCGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD1 1.5 PD34 2001 (SEQ ID NO: 1152) Amino Acid Sequence:

(SEQ ID NO: 1151)
[QGQSGQG][TSYCSIEHYPCNTHHGGGSSGGSISSGLLSGRSDNHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD1 1.5 PD34 2001 Amino Acid Sequence:

(SEQ ID NO: 1152)
TSYCSIEHYPCNTHHGGGSSGGSISSGLLSGRSDNHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 1125)] [PD1 1.5 PD034 2001 (SEQ ID NO: 1153)] Nucleotide Sequence:

(SEQ ID NO: 1154)
[CAGGGGCAATCTGGCCAGGGG][ACGTCTTACTGCAGTATTGAGCATTA
CCCCTGCAATACACATCATGGAGGTGGCTCGAGCGGCGGCTCTATCTCTT
CCGGACTGCTGTCCGGCAGATCCGACAATCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD1 1.5 PD34 1004/GG/0001 (SEQ ID NO: 1156) Amino Acid Sequence:

(SEQ ID NO: 1155)
[QGQSGQG][TSYCSIEHYPCNTHHGGGSSGGSAVGLLAPPGGLSGRSDN
HGGGSDIQLTQSPSSLSASVGDRVTITCRASESVDAYGISFMNWFQQKPG
KAPKLLIYAASNQGSGVPSRFSGSGSGTDFTLTISSMQPEDFATYYCQQS
KDVPWTFGQGTKLEIK]

PD1 1.5 PD34 1004/GG/0001 Amino Acid Sequence:

(SEQ ID NO: 1156)
TSYCSIEHYPCNTHHGGGSSGGSAVGLLAPPGGLSGRSDNHGGGSDIQLT
QSPSSLSASVGDRVTITCRASESVDAYGISFMNWFQQKPGKAPKLLIYAA
SNQGSGVPSRFSGSGSGTDFTLTISSMQPEDFATYYCQQSKDVPWTFGQG
TKLEIK

[Spacer (SEQ ID NO: 362)] [PD1 1.5 PD34 2005 (SEQ ID NO: 1160) Amino Acid Sequence:

(SEQ ID NO: 1159)
[QGQSGQG][TSYCSIEHYPCNTHHGGGSSGGSAVGLLAPPSGRSANPRG
GGGSDIQLTQSPSSLSASVGDRVTITCRASESVDAYGISFMNWFQQKPGK
APKLLIYAASNQGSGVPSRFSGSGSGTDFTLTISSMQPEDFATYYCQQSK
DVPWTFGQGTKLEIK]

PD1 1.5 PD34 2005 Amino Acid Sequence:

(SEQ ID NO: 1160)
TSYCSIEHYPCNTHHGGGSSGGSAVGLLAPPSGRSANPRGGGGSDIQLTQ
SPSSLSASVGDRVTITCRASESVDAYGISFMNWFQQKPGKAPKLLIYAAS
NQGSGVPSRFSGSGSGTDFTLTISSMQPEDFATYYCQQSKDVPWTFGQGT
KLEIK

[Spacer (SEQ ID NO: 362)] [PD1 1.5 PD34 2010 (SEQ ID NO: 1164) Amino Acid Sequence:

(SEQ ID NO: 1163)
[QGQSGQG][TSYCSIEHYPCNTHHGGGSSGGSISSGLLSGRSDYHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD1 1.5 PD34 2010 Amino Acid Sequence:

(SEQ ID NO: 1164)
TSYCSIEHYPCNTHHGGGSSGGSISSGLLSGRSDYHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 362)] [PD1 1.5 PD34 2014 (SEQ ID NO: 1168) Amino Acid Sequence:

(SEQ ID NO: 1167)
[QGQSGQG][TSYCSIEHYPCNTHHGGGSSGGSISSGLLSGRSDNIGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD1 1.5 PD34 2014 Amino Acid Sequence:

(SEQ ID NO: 1168)
TSYCSIEHYPCNTHHGGGSSGGSISSGLLSGRSDNIGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 362)] [PD1 1.5 PD34 2003 (SEQ ID NO: 1170) Amino Acid Sequence:

(SEQ ID NO: 1171)
[QGQSGQG][TSYCSIEHYPCNTHHGGGSSGGSISSGLLSGRSANPRGGG
SDIQLTQSPSSLSASVGDRVTITCRASESVDAYGISFMNWFQQKPGKAPK
LLIYAASNQGSGVPSRFSGSGSGTDFTLTISSMQPEDFATYYCQQSKDVP
WTFGQGTKLEIK]

PD1 1.5 PD34 2003 Amino Acid Sequence:

(SEQ ID NO: 1170)
TSYCSIEHYPCNTHHGGGSSGGSISSGLLSGRSANPRGGGSDIQLTQSPS
SLSASVGDRVTITCRASESVDAYGISFMNWFQQKPGKAPKLLIYAASNQG
SGVPSRFSGSGSGTDFTLTISSMQPEDFATYYCQQSKDVPWTFGQGTKLE
IK

[Spacer (SEQ ID NO: 1125)] [PD1 1.5 PD034 2003 (SEQ ID NO: 1172)] Nucleotide Sequence:

```
                                        (SEQ ID NO: 1173)
[CAGGGGCAATCTGGCCAGGGG][ACGTCTTACTGCAGTATTGAGCATTA

CCCCTGCAATACACATCATGGAGGTGGCTCGAGCGGCGGCTCTATCTCTT

CCGGACTGCTGTCCGGCAGATCCGCCAATCCTCGTGGCGGAGGATCCGAT

ATCCAGCTGACCCAGAGCCCTAGCAGCCTGTCTGCCAGCGTGGGCGACAG

AGTGACCATCACCTGTAGAGCCAGCGAGAGCGTGGACGCTTACGGCATCA

GCTTCATGAACTGGTTCCAGCAGAAGCCCGGCAAGGCCCCCAAGCTGCTG

ATCTACGCCGCCAGCAATCAGGGCAGCGGCGTGCCAAGCAGATTTTCCGG

CTCTGGCAGCGGCACCGACTTCACCCTGACCATCAGCAGCATGCAGCCCG

AGGACTTCGCCACCTACTACTGCCAGCAGAGCAAGGACGTGCCCTGGACC

TTTGGCCAGGGTACCAAGCTGGAAATCAAG]
```

[Spacer (SEQ ID NO: 362)] [PD1 1.5 PD34 2006 (SEQ ID NO: 1174) Amino Acid Sequence:

```
                                        (SEQ ID NO: 1175)
[QGQSGQG][TSYCSIEHYPCNTHHGGGSSGGSISSGLLSGRSDDHGGGS

DIQLTQSPSSLSASVGDRVTITCRASESVDAYGISFMNWFQQKPGKAPKL

LIYAASNQGSGVPSRFSGSGSGTDFTLTISSMQPEDFATYYCQQSKDVPW

TFGQGTKLEIK]
```

PD1 1.5 PD34 2006 Amino Acid Sequence:

```
                                        (SEQ ID NO: 1174)
TSYCSIEHYPCNTHHGGGSSGGSISSGLLSGRSDDHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K
```

[Spacer (SEQ ID NO: 1125)] [PD1 1.5 PD034 2006 (SEQ ID NO: 1176)] Nucleotide Sequence:

```
                                        (SEQ ID NO: 1177)
[CAGGGGCAATCTGGCCAGGGG][ACGTCTTACTGCAGTATTGAGCATTA

CCCCTGCAATACACATCATGGAGGTGGCTCGAGCGGCGGCTCTATCTCTT

CCGGACTGCTGTCCGGCAGATCCGACGATCACGGCGGAGGATCCGATATC

CAGCTGACCCAGAGCCCTAGCAGCCTGTCTGCCAGCGTGGGCGACAGAGT

GACCATCACCTGTAGAGCCAGCGAGAGCGTGGACGCTTACGGCATCAGCT

TCATGAACTGGTTCCAGCAGAAGCCCGGCAAGGCCCCCAAGCTGCTGATC

TACGCCGCCAGCAATCAGGGCAGCGGCGTGCCAAGCAGATTTTCCGGCTC

TGGCAGCGGCACCGACTTCACCCTGACCATCAGCAGCATGCAGCCCGAGG

ACTTCGCCACCTACTACTGCCAGCAGAGCAAGGACGTGCCCTGGACCTTT

GGCCAGGGTACCAAGCTGGAAATCAAG]
```

[Spacer (SEQ ID NO: 362)] [PD1 1.5 PD34 2007 (SEQ ID NO: 1178) Amino Acid Sequence:

```
                                        (SEQ ID NO: 1179)
[QGQSGQG][TSYCSIEHYPCNTHHGGGSSGGSISSGLLSGRSDIHGGGS

DIQLTQSPSSLSASVGDRVTITCRASESVDAYGISFMNWFQQKPGKAPKL

LIYAASNQGSGVPSRFSGSGSGTDFTLTISSMQPEDFATYYCQQSKDVPW

TFGQGTKLEIK]
```

PD1 1.5 PD34 2007 Amino Acid Sequence:

```
                                        (SEQ ID NO: 1178)
TSYCSIEHYPCNTHHGGGSSGGSISSGLLSGRSDIHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K
```

[Spacer (SEQ ID NO: 1125)] [PD1 1.5 PD034 2007 (SEQ ID NO: 1180)] Nucleotide Sequence:

```
                                        (SEQ ID NO: 1181)
[CAGGGGCAATCTGGCCAGGGG][ACGTCTTACTGCAGTATTGAGCATTA

CCCCTGCAATACACATCATGGAGGTGGCTCGAGCGGCGGCTCTATCTCTT

CCGGACTGCTGTCCGGCAGATCCGACATTCACGGCGGAGGATCCGATATC

CAGCTGACCCAGAGCCCTAGCAGCCTGTCTGCCAGCGTGGGCGACAGAGT

GACCATCACCTGTAGAGCCAGCGAGAGCGTGGACGCTTACGGCATCAGCT

TCATGAACTGGTTCCAGCAGAAGCCCGGCAAGGCCCCCAAGCTGCTGATC

TACGCCGCCAGCAATCAGGGCAGCGGCGTGCCAAGCAGATTTTCCGGCTC

TGGCAGCGGCACCGACTTCACCCTGACCATCAGCAGCATGCAGCCCGAGG

ACTTCGCCACCTACTACTGCCAGCAGAGCAAGGACGTGCCCTGGACCTTT

GGCCAGGGTACCAAGCTGGAAATCAAG]
```

[Spacer (SEQ ID NO: 362)] [PD1 1.5 PD34 2009 (SEQ ID NO: 1182) Amino Acid Sequence:

```
                                        (SEQ ID NO: 1183)
[QGQSGQG][TSYCSIEHYPCNTHHGGGSSGGSISSGLLSGRSDTHGGGS

DIQLTQSPSSLSASVGDRVTITCRASESVDAYGISFMNWFQQKPGKAPKL

LIYAASNQGSGVPSRFSGSGSGTDFTLTISSMQPEDFATYYCQQSKDVPW

TFGQGTKLEIK]
```

[PD1 1.5 PD34 2009 Amino Acid Sequence:

```
                                        (SEQ ID NO: 1182)
TSYCSIEHYPCNTHHGGGSSGGSISSGLLSGRSDTHGGGSDIQLTQSPSS

LSASVGDRVTITCRASESVDAYGISFMNWFQQKPGKAPKLLIYAASNQGS

GVPSRFSGSGSGTDFTLTISSMQPEDFATYYCQQSKDVPWTFGQGTKLEI

K
```

[Spacer (SEQ ID NO: 1125)] [PD1 1.5 PD034 2009 (SEQ ID NO: 1184)] Nucleotide Sequence:

(SEQ ID NO: 1185)
[CAGGGGCAATCTGGCCAGGGG][ACGTCTTACTGCAGTATTGAGCATTA
CCCCTGCAATACACATCATGGAGGTGGCTCGAGCGGCGGCTCTATCTCTT
CCGGACTGCTGTCCGGCAGATCCGACACTCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD1 1.5 PD34 2008 (SEQ ID NO: 1186) Amino Acid Sequence:

(SEQ ID NO: 1187)
[QGQSGQG][TSYCSIEHYPCNTHHGGGSSGGSISSGLLSGRSDQHGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD1 1.5 PD34 2008 Amino Acid Sequence:

(SEQ ID NO: 1186)
TSYCSIEHYPCNTHHGGGSSGGSISSGLLSGRSDQHGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 1125)] [PD1 1.5 PD034 2008 (SEQ ID NO: 1188)] Nucleotide Sequence:

(SEQ ID NO: 1189)
[CAGGGGCAATCTGGCCAGGGG][ACGTCTTACTGCAGTATTGAGCATTA
CCCCTGCAATACACATCATGGAGGTGGCTCGAGCGGCGGCTCTATCTCTT
CCGGACTGCTGTCCGGCAGATCCGACCAGCACGGCGGAGGATCCGATATC
CAGCTGACCCAGAGCCCTAGCAGCCTGTCTGCCAGCGTGGGCGACAGAGT
GACCATCACCTGTAGAGCCAGCGAGAGCGTGGACGCTTACGGCATCAGCT
TCATGAACTGGTTCCAGCAGAAGCCCGGCAAGGCCCCCAAGCTGCTGATC
TACGCCGCCAGCAATCAGGGCAGCGGCGTGCCAAGCAGATTTTCCGGCTC
TGGCAGCGGCACCGACTTCACCCTGACCATCAGCAGCATGCAGCCCGAGG
ACTTCGCCACCTACTACTGCCAGCAGAGCAAGGACGTGCCCTGGACCTTT
GGCCAGGGTACCAAGCTGGAAATCAAG]

[Spacer (SEQ ID NO: 362)] [PD1 1.5 PD34 2012 (SEQ ID NO: 1190) Amino Acid Sequence:

(SEQ ID NO: 1191)
[QGQSGQG][TSYCSIEHYPCNTHHGGGSSGGSISSGLLSGRSANPGGGS
DIQLTQSPSSLSASVGDRVTITCRASESVDAYGISFMNWFQQKPGKAPKL
LIYAASNQGSGVPSRFSGSGSGTDFTLTISSMQPEDFATYYCQQSKDVPW
TFGQGTKLEIK]

PD1 1.5 PD34 2012 Amino Acid Sequence:

(SEQ ID NO: 1190)
TSYCSIEHYPCNTHHGGGSSGGSISSGLLSGRSANPGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 1125)] [PD1 1.5 PD034 2012 (SEQ ID NO: 1192)] Nucleotide Sequence:

(SEQ ID NO: 1193)
[CAGGGGCAATCTGGCCAGGGG][ACGTCTTACTGCAGTATTGAGCAT
TACCCCTGCAATACACATCATGGAGGTGGCTCGAGCGGCGGCTCTATCT
CTTCCGGACTGCTGTCCGGCAGATCCGCTAATCCCGGCGGAGGATCCG
ATATCCAGCTGACCCAGAGCCCTAGCAGCCTGTCTGCCAGCGTGGGCGA
CAGAGTGACCATCACCTGTAGAGCCAGCGAGAGCGTGGACGCTTACGGCA
TCAGCTTCATGAACTGGTTCCAGCAGAAGCCCGGCAAGGCCCCCAAGCTG
CTGATCTACGCCGCCAGCAATCAGGGCAGCGGCGTGCCAAGCAGATTTTC
CGGCTCTGGCAGCGGCACCGACTTCACCCTGACCATCAGCAGCATGCAGC
CCGAGGACTTCGCCACCTACTACTGCCAGCAGAGCAAGGACGTGCCCTGG
ACCTTTGGCCAGGGTACCAAGCTGGAAATCAAG]

[Spacer (SEQ ID NO: 362)] [PD1 1.5 PD34 2013 (SEQ ID NO: 1194) Amino Acid Sequence:

(SEQ ID NO: 1195)
[QGQSGQG][TSYCSIEHYPCNTHHGGGSSGGSISSGLLSGRSANIG
GGSDIQLTQSPSSLSASVGDRVTITCRASESVDAYGISFMNWFQQKPGK
APKLLIYAASNQGSGVPSRFSGSGSGTDFTLTISSMQPEDFATYYCQQS
KDVPWTFGQGTKLEIK]

PD1 1.5 PD34 2013 Amino Acid Sequence:

(SEQ ID NO: 1194)
TSYCSIEHYPCNTHHGGGSSGGSISSGLLSGRSANIGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 1125)] [PD1 1.5 PD034 2013 (SEQ ID NO: 1196)] Nucleotide Sequence:

(SEQ ID NO: 1197)
[CAGGGGCAATCTGGCCAGGGG][ACGTCTTACTGCAGTATTGAGCA
TTACCCCTGCAATACACATCATGGAGGTGGCTCGAGCGGCGGCTCTATC
TCTTCCGGACTGCTGTCCGGCAGATCCGCTAATATTGGCGGAGGATCCG
ATATCCAGCTGACCCAGAGCCCTAGCAGCCTGTCTGCCAGCGTGGGCGA
CAGAGTGACCATCACCTGTAGAGCCAGCGAGAGCGTGGACGCTTACGGCA
TCAGCTTCATGAACTGGTTCCAGCAGAAGCCCGGCAAGGCCCCCAAGCTG
CTGATCTACGCCGCCAGCAATCAGGGCAGCGGCGTGCCAAGCAGATTTTC
CGGCTCTGGCAGCGGCACCGACTTCACCCTGACCATCAGCAGCATGCAGC
CCGAGGACTTCGCCACCTACTACTGCCAGCAGAGCAAGGACGTGCCCTGG
ACCTTTGGCCAGGGTACCAAGCTGGAAATCAAG]

[Spacer (SEQ ID NO: 362)] [PD1 1.5 PD34 2011 (SEQ ID NO: 1198) Amino Acid Sequence:

(SEQ ID NO: 1199)
[QGQSGQG][TSYCSIEHYPCNTHHGGGSSGGSISSGLLSGRSDNPG
GGSDIQLTQSPSSLSASVGDRVTITCRASESVDAYGISFMNWFQQKPGK
APKLLIYAASNQGSGVPSRFSGSGSGTDFTLTISSMQPEDFATYYCQQS
KDVPWTFGQGTKLEIK]

PD1 1.5 PD34 2011 Amino Acid Sequence:

(SEQ ID NO: 1198)
TSYCSIEHYPCNTHHGGGSSGGSISSGLLSGRSDNPGGGSDIQLTQSPSS
LSASVGDRVTITCRASESVDAYGISFMNWFQQKPGKAPKLLIYAASNQGS
GVPSRFSGSGSGTDFTLTISSMQPEDFATYYCQQSKDVPWTFGQGTKLEI
K

[Spacer (SEQ ID NO: 1125)] [PD1 1.5 PD034 2011 (SEQ ID NO: 1200)] Nucleotide Sequence:

(SEQ ID NO: 1201)
[CAGGGGCAATCTGGCCAGGGG][ACGTCTTACTGCAGTATTGAGCAT
TACCCCTGCAATACACATCATGGAGGTGGCTCGAGCGGCGGCTCTATCT
CTTCCGGACTGCTGTCCGGCAGATCCGACAATCCCGGCGGAGGATCCGA
TATCCAGCTGACCCAGAGCCCTAGCAGCCTGTCTGCCAGCGTGGGCGAC
AGAGTGACCATCACCTGTAGAGCCAGCGAGAGCGTGGACGCTTACGGCA
TCAGCTTCATGAACTGGTTCCAGCAGAAGCCCGGCAAGGCCCCCAAGCTG
CTGATCTACGCCGCCAGCAATCAGGGCAGCGGCGTGCCAAGCAGATTTTC
CGGCTCTGGCAGCGGCACCGACTTCACCCTGACCATCAGCAGCATGCAGC
CCGAGGACTTCGCCACCTACTACTGCCAGCAGAGCAAGGACGTGCCCTGG
ACCTTTGGCCAGGGTACCAAGCTGGAAATCAAG]

[Spacer (SEQ ID NO: 362)] [PD1 1.5 PD006 2003 (SEQ ID NO: 1202) Amino Acid Sequence:

(SEQ ID NO: 1203)
[QGQSGQG][APRCYMFASYCKSQYGGGSSGGSISSGLLSGRSANPRG
GGSDIQLTQSPSSLSASVGDRVTITCRASESVDAYGISFMNWFQQKPGK
APKLLIYAASNQGSGVPSRFSGSGSGTDFTLTISSMQPEDFATYYCQQS
KDVPWTFGQGTKLEIK]

PD1 1.5 PD006 2003 Amino Acid Sequence:

(SEQ ID NO: 1202)
APRCYMFASYCKSQYGGGSSGGSISSGLLSGRSANPRGGGSDIQLTQSPS
SLSASVGDRVTITCRASESVDAYGISFMNWFQQKPGKAPKLLIYAASNQG
SGVPSRFSGSGSGTDFTLTISSMQPEDFATYYCQQSKDVPWTFGQGTKLE
IK

[Spacer (SEQ ID NO: 918)] [PD1 1.5 PD006 2003 (SEQ ID NO: 1204)] Nucleotide Sequence:

(SEQ ID NO: 1205)
[CAAGGCCAGTCTGGCCAAGGT][GCGCCTAGGTGCTATATGTTTGCG
TCGTATTGCAAGAGTCAGTATGGAGGTGGCTCGAGCGGCGGCTCTATCT
CTTCCGGACTGCTGTCCGGCAGATCCGCCAATCCTCGTGGCGGAGGATC
CGATATCCAGCTGACCCAGAGCCCTAGCAGCCTGTCTGCCAGCGTGGGC
GACAGAGTGACCATCACCTGTAGAGCCAGCGAGAGCGTGGACGCTTACG
GCATCAGCTTCATGAACTGGTTCCAGCAGAAGCCCGGCAAGGCCCCCAAG
CTGCTGATCTACGCCGCCAGCAATCAGGGCAGCGGCGTGCCAAGCAGATT
TTCCGGCTCTGGCAGCGGCACCGACTTCACCCTGACCATCAGCAGCATGC
AGCCCGAGGACTTCGCCACCTACTACTGCCAGCAGAGCAAGGACGTGCCC
TGGACCTTTGGCCAGGGTACCAAGCTGGAAATCAAG]

Example 19: Activatable Anti-PD1 Nivolumab Masking Moieties

This example describes identification of masking moieties (MM) that reduce binding of anti-PD1 Nivolumab antibody to its target.

Anti-PD1 Nivolumab (NV1) (see, e.g., U.S. Pat. No. 8,008,449) was used to screen libraries using a method similar to that described in PCT International Publication Number WO 2010/081173, published 15 Jul. 2010. The screening consisted of one round of MACS and four rounds of FACS sorting. For the initial MACS, approximately $6\times10^{11}$ cells were incubated with NV1 antibody at a concentration of 100 nM, and approximately $3\times10^{7}$ binders were collected using Protein-A Dynabeads (Life Technologies, Carlsbad, Calif.). FACS rounds were conducted labeling cells with DyLight 650 (Thermo-Fisher) labeled NV1 antibody and collecting cells with strongest fluorescence as follows: 20 nM NV1-650 collecting brightest 13% for FACS round 1 (F1), 2 nM NV1-650 collecting brightest 2% for FACS round 2 (F2-1), 1 nM NV1-650 collecting brightest 1% for FACS round 3 (F3-1b) and 1 nM NV1-650 collecting two populations, the brightest 88% and the brightest 1% for FACS round 4 (F4-1b.1 and F4-1b.2). Individual peptide clones from F4-1b.1 and F4-1b.2 were identified by sequence analysis (Table 19), and selected peptide clones NV01-NV12 were subsequently verified for their ability to bind NV1 (masking moiety NV001 is also referred to herein as NV01 and/or NV-01; masking moiety NV002 is also referred to herein as NV02 and/or NV-02, and so on).

TABLE 19

| Mask | Amino Acid Sequence | SEQ ID NO: |
|---|---|---|
| NV01 | RYCHAANPDRFCGIY | 1206 |
| NV02 | PRVCSTDGGDYCLLP | 1207 |
| NV03 | PRPQCHHRHNCPDHP | 1208 |
| NV04 | KCSRPAHQNPDRCSR | 1209 |
| NV05 | ASYRCPDYKCSHTKH | 1210 |
| NV06 | LPRCPDHPIKCIETK | 1211 |
| NV07 | YTFGCPDRYCDRAAT | 1212 |
| NV08 | RGCPDFNPPSHCYTA | 1213 |
| NV09 | RDYCGPQSPDYCHEI | 1214 |
| NV10 | PNKPCPDLQCYVTNY | 1215 |
| NV11 | PRVACGEPDLCYSNT | 1216 |
| NV12 | RGCKKHTISTLTCPD | 1217 |
| NV13 | PAYRCPDRPPCKNQM | 1218 |
| NV14 | NARCYPYFGDNCHMN | 1220 |
| NV15 | PTLRCPDRWCYDSPR | 1221 |
| NV16 | PSNLCPDKWCQTWRS | 1222 |
| NV17 | TPRYCAASYCPAHGY | 1223 |
| NV18 | RPGCGAVSPRCPDAP | 1224 |
| NV19 | VLRCHKQNPDNCNNH | 1225 |
| NV20 | GVKSCREPDFCSRGS | 1226 |
| NV21 | RNNLCPDYSCNNHNS | 1227 |
| NV22 | RAACHRLNPDACTNG | 1228 |
| NV23 | VCQSDRIPDYVTCTD | 1229 |
| NV24 | RNCRIASINPDYCNI | 1230 |
| NV25 | KEWRCPDYKCKPSYH | 1231 |
| NV26 | NLRICHKSLCPDYIK | 1232 |
| NV27 | NTHKCSNTNICPSFN | 1233 |
| NV28 | STRYCQASQCQMSPY | 1234 |
| NV29 | THRFCTASLCNKNTS | 1235 |
| NV30 | YTLCNTRSPDWCPNK | 1236 |
| NV31 | IRCTTGQSPDYCPQS | 1237 |
| NV32 | RCNQPDKNDQMLCNI | 1238 |
| NV33 | GTCRTDHQSPDYCYY | 1239 |
| NV34 | RGCFRSGDSLGMCPD | 1240 |
| NV35 | SGCFDSNEHRHCSRI | 1241 |

TABLE 19-continued

| Mask | Amino Acid Sequence | SEQ ID NO: |
|---|---|---|
| NV36 | NRCMKLWYNPDCVAR | 1242 |
| NV37 | PLCARPHYWSPCDQS | 1243 |
| NV38 | DSKCHPNSPDYCFNS | 1244 |
| NV39 | NGSCRPLGGDFCGNR | 1245 |
| NV40 | KTRCIEMSGDYCAKS | 1246 |
| NV41 | IRPCMYNWGDLCNQF | 1247 |
| NV42 | VKTCMENNPDYCYNN | 1248 |
| NV43 | LRMCFEASGDYCDQQ | 1249 |
| NV44 | IRKCQLDGPDQCMLT | 1250 |
| NV45 | KWKCHKNNPNYCNNR | 1251 |
| NV46 | RTMCLDTNPDYCQSH | 1252 |
| NV47 | LAACHSMDSHRCPDY | 1253 |
| NV48 | RSPCIHNATMCPDYT | 1254 |
| NV49 | MPRCPDWPPRCSMVI | 1255 |
| NV50 | VRQLCRLPDYCPSGK | 1256 |
| NV51 | PRPPCAQSLNCPDRA | 1257 |
| NV52 | SFGRCTLVRTCPDFM | 1258 |
| NV53 | RDKPCPDFSCATIHY | 1259 |
| NV54 | ATKPCPDRWCTMSTL | 1260 |
| NV55 | SSNRCPDLRCTHHNM | 1261 |
| NV56 | RGSMCPDLHCSLSHI | 1262 |
| NV57 | NYQRCPDRTCMHNII | 1263 |
| NV58 | QKRPCPDRKCHAHYN | 1264 |
| NV59 | QNHRCPDRWCNKTTN | 1265 |
| NV60 | RLNLCPDKHCHMTNL | 1266 |
| NV61 | PQDRCPDKRCTNPGN | 1267 |
| NV62 | SRWRCPDYKCEHGKY | 1268 |
| NV63 | YENQCPDLYCNRYSM | 1269 |
| NV64 | TARSCPVFNCPDNNS | 1270 |
| NV65 | MDQRCPDAWCTSKPK | 1271 |
| NV66 | GDLRCPDRLCPRHSL | 1272 |
| NV67 | IQYLCPDYHCKASNN | 1273 |
| NV68 | QHHRCPDRYCNSNNN | 1274 |
| NV69 | TVALCPDYSCYHINN | 1275 |
| NV70 | SPWRCPDRYCLSNHD | 1276 |
| NV71 | SSKRCPDRFCNKTHA | 1277 |
| NV72 | HTDRCPDYKCSQNHF | 1278 |
| NV73 | SRSNCTPQRCNSDYH | 1279 |
| NV74 | FAARCPDKYCAIHTN | 1280 |

TABLE 19-continued

| Mask | Amino Acid Sequence | SEQ ID NO: |
|---|---|---|
| NV75 | GSARCPDLVCQQTKQ | 1281 |
| NV76 | RNLMCPDKFCNKNTK | 1282 |
| NV77 | NIRLCPDKVCTPTWV | 1283 |
| NV78 | MTDLCPDAHCAKTHM | 1284 |
| NV79 | PYSRLCAYPCPDFVG | 1285 |
| NV80 | LCGCARSPDYCKCRG | 1286 |
| NV81 | WGRCERVPDCCCPRG | 1287 |
| NV82 | TRNTCHTRICYGMAC | 1288 |
| NV83 | CVCTSCSSYWTLCPD | 1289 |
| NV84 | LCCSRGSNCPDRCTW | 1290 |
| NV85 | CCPLCQANMCPDNQS | 1291 |
| NV86 | ECKLCCPDLYCGGTM | 1292 |
| NV87 | CSNPMCAYCCPDLIL | 1293 |
| NV88 | CPRCNTYSKHDCYHQ | 1294 |
| NV89 | FCCASKMPAPSNCHT | 1295 |

Example 20: Activatable Anti-PD1 Nivolumab Antibodies

This example describes examples of activatable anti-PD1 Nivolumab antibodies of the disclosure.

Activatable anti-PD1 NV1 antibodies comprising an anti-PD1 NV1 masking moiety, a cleavable moiety, and an anti-PD1 NV1 antibody of the disclosure were produced according to methods similar to those described in PCT Publication Nos. WO 2009/025846 and WO 2010/081173. One embodiment of the disclosure is an anti-PD-1 activatable antibody comprising a heavy chain comprising amino acid sequence SEQ ID NO: 1346. One embodiment of the disclosure is an anti-PD-1 activatable antibody comprising a light chain comprising amino acid sequence SEQ ID NO: 626. One embodiment of the disclosure is an anti-PD-1 activatable antibody comprising a heavy chain comprising amino acid sequence SEQ ID NO: 1346 and a light chain comprising amino acid sequence SEQ ID NO: 626. One embodiment of the disclosure is an anti-PD-1 activatable antibody comprising the CDRs of an anti-PD-1 activatable antibody comprising a heavy chain comprising amino acid sequence SEQ ID NO: 1346 and a light chain comprising amino acid sequence SEQ ID NO: 626.

The amino acid and nucleic acid sequences of several activatable anti-PD1 antibody variable domains of the disclosure are provided below. Antibodies were produced as hIgG4 containing a single amino acid substitution, S228P (Angal, et al. 1993. Mol Immunol 30:105-8.) HC and hK LC format.

NV1 Light Chain Sequence:

(SEQ ID NO: 626)
EIVLTQSPATLSLSPGERATLSCRAS<u>QSVSSY</u>LAWYQQKPGQAPRLLIY

<u>DAS</u>NRATGIPARFSGSGSGTDFTLTISSLEPEDFAVYYC<u>QQSSNWPRT</u>F

GQGTKVEIK

[Spacer (SEQ ID NO: 362)] [NV1 NV01 2001 (SEQ ID NO: 1296) Amino Acid Sequence:

(SEQ ID NO: 1297)
[QGQSGQG][RYCHAANPDRFCGIYGGGSSGGSISSGLLSGRSDNHGG

SEIVLTQSPATLSLSPGERATLSCRASQSVSSYLAWYQQKPGQAPRLLI

YDASNRATGIPARFSGSGSGTDFTLTISSLEPEDFAVYYCQQSSNWPRT

FGQGTKVEIK]

NV1 NV01 2001 Amino Acid Sequence:

(SEQ ID NO: 1296)
RYCHAANPDRFCGIYGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV01 2001 (SEQ ID NO: 1298)] Nucleotide Sequence:

(SEQ ID NO: 1299)
[CAAGGCCAGTCTGGCCAAGGT][CGGTATTGCCATGCTGCGAATCCT

GATCGGTTTTGCGGTATTTATGGAGGTGGCTCGAGCGGCGGCTCTATCT

CTTCCGGACTGCTGTCCGGCAGATCCGACAATCACGGCGGATCCGAGAT

CGTGCTGACACAGAGCCCTGCCACCCTGTCTCTGAGCCCTGGCGAAAGA

GCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

TGTACTACTGCCAGCAGAGCAGCAACTGGCCCCGGACATTTGGCCAGGGC

ACCAAGGTGGAAATCAAG]

[Spacer (SEQ ID NO: 362)] [NV1 NV02 2001 (SEQ ID NO: 1300) Amino Acid Sequence:

(SEQ ID NO: 1301)
[QGQSGQG][PRVCSTDGGDYCLLPGGGSSGGSISSGLLSGRSD

NHGGSEIVLTQSPATLSLSPGERATLSCRASQSVSSYLAWYQQKPGQAPR

LLIYDASNRATGIPARFSGSGSGTDFTLTISSLEPEDFAVYYCQQSSNWP

RTFGQGTKVEIK]

NV1 NV02 2001 Amino Acid Sequence:

(SEQ ID NO: 1300)
PRVCSTDGGDYCLLPGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV02 2001 (SEQ ID NO: 1302)] Nucleotide Sequence:

(SEQ ID NO: 1303)
[CAAGGCCAGTCTGGCCAAGGT][CCTAGGGTTTGCTCTACTGA

TGGTGGTGATTATTGCTTGCTTCCTGGAGGTGGCTCGAGCGGCGGCTCTA

-continued

TCTCTTCCGGACTGCTGTCCGGCAGATCCGACAATCACGGCGGATCCGAG

ATCGTGCTGACACAGAGCCCTGCCACCCTGTCTCTGAGCCCTGGCGAAAG

AGCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

TGTACTACTGCCAGCAGAGCAGCAACTGGCCCCGGACATTTGGCCAGGGC

ACCAAGGTGGAAATCAAG]

[Spacer (SEQ ID NO: 362)] [NV1 NV03 2001 (SEQ ID NO: 1304) Amino Acid Sequence:

(SEQ ID NO: 1305)
[QGQSGQG][PRPQCHHRHNCPDHPGGGSSGGSISSGLLSGRSD

NHGGSEIVLTQSPATLSLSPGERATLSCRASQSVSSYLAWYQQKPGQAPR

LLIYDASNRATGIPARFSGSGSGTDFTLTISSLEPEDFAVYYCQQSSNWP

RTFGQGTKVEIK]

NV1 NV03 2001 Amino Acid Sequence:

(SEQ ID NO: 1304)
PRPQCHHRHNCPDHPGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV03 2001 (SEQ ID NO: 1306)] Nucleotide Sequence:

(SEQ ID NO: 1307)
[CAAGGCCAGTCTGGCCAAGGT][CCTCGTCCGCAGTGCCATCA

TCGGCATAATTGTCCTGATCATCCTGGAGGTGGCTCGAGCGGCGGCTCTA

TCTCTTCCGGACTGCTGTCCGGCAGATCCGACAATCACGGCGGATCCGAG

ATCGTGCTGACACAGAGCCCTGCCACCCTGTCTCTGAGCCCTGGCGAAAG

AGCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

TGTACTACTGCCAGCAGAGCAGCAACTGGCCCCGGACATTTGGCCAGGGC

ACCAAGGTGGAAATCAAG]

[Spacer (SEQ ID NO: 362)] [NV1 NV04 2001 (SEQ ID NO: 1308) Amino Acid Sequence:

(SEQ ID NO: 1309)
[QGQSGQG][KCSRPAHQNPDRCSRGGGSSGGSISSGLLSGRSD

NHGGSEIVLTQSPATLSLSPGERATLSCRASQSVSSYLAWYQQKPGQAPR

LLIYDASNRATGIPARFSGSGSGTDFTLTISSLEPEDFAVYYCQQSSNWP

RTFGQGTKVEIK]

NV1 NV04 2001 Amino Acid Sequence:

(SEQ ID NO: 1308)
KCSRPAHQNPDRCSRGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV04 2001 (SEQ ID NO: 1310)] Nucleotide Sequence:

(SEQ ID NO: 1311)
[CAAGGCCAGTCTGGCCAAGGT][AAGTGCTCGCGGCCTGCTCA

TCAGAATCCGGATCGTTGCTCGCGAGGAGGTGGCTCGAGCGGCGGCTCTA

TCTCTTCCGGACTGCTGTCCGGCAGATCCGACAATCACGGCGGATCCGAG

ATCGTGCTGACACAGAGCCCTGCCACCCTGTCTCTGAGCCCTGGCGAAAG

AGCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

TGTACTACTGCCAGCAGAGCAGCAACTGGCCCCGGACATTTGGCCAGGGC

ACCAAGGTGGAAATCAAG]

[Spacer (SEQ ID NO: 362)] [NV1 NV05 2001 (SEQ ID NO: 1312) Amino Acid Sequence:

(SEQ ID NO: 1313)
[QGQSGQG][ASYRCPDYKCSHTKHGGGSSGGSISSGLLSGRSD

NHGGSEIVLTQSPATLSLSPGERATLSCRASQSVSSYLAWYQQKPGQAPR

LLIYDASNRATGIPARFSGSGSGTDFTLTISSLEPEDFAVYYCQQSSNWP

RTFGQGTKVEIK]

NV1 NV05 2001 Amino Acid Sequence:

(SEQ ID NO: 1312)
ASYRCPDYKCSHTKHGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV05 2001 (SEQ ID NO: 1314)] Nucleotide Sequence:

(SEQ ID NO: 1315)
[CAAGGCCAGTCTGGCCAAGGT][GCTTCGTATCGGTGCCCTGA

TTATAAGTGCAGTCATACTAAGCATGGAGGTGGCTCGAGCGGCGGCTCTA

TCTCTTCCGGACTGCTGTCCGGCAGATCCGACAATCACGGCGGATCCGAG

ATCGTGCTGACACAGAGCCCTGCCACCCTGTCTCTGAGCCCTGGCGAAAG

AGCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

-continued
TGTACTACTGCCAGCAGAGCAGCAACTGGCCCCGGACATTTGGCCAGGGC

ACCAAGGTGGAAATCAAG]

[Spacer (SEQ ID NO: 362)] [NV1 NV06 2001 (SEQ ID NO: 1316) Amino Acid Sequence:

(SEQ ID NO: 1317)
[QGQSGQG][LPRCPDHPIKCIETKGGGSSGGSISSGLLSGRSD

NHGGSEIVLTQSPATLSLSPGERATLSCRASQSVSSYLAWYQQKPGQAPR

LLIYDASNRATGIPARFSGSGSGTDFTLTISSLEPEDFAVYYCQQSSNWP

RTFGQGTKVEIK]

NV1 NV06 2001 Amino Acid Sequence:

(SEQ ID NO: 1316)
LPRCPDHPIKCIETKGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV06 2001 (SEQ ID NO: 1318)] Nucleotide Sequence:

(SEQ ID NO: 1319)
[CAAGGCCAGTCTGGCCAAGGT][TTGCCGAGGTGCCCGGATCA

TCCGATTAAGTGCATTGAGACTAAGGGAGGTGGCTCGAGCGGCGGCTCTA

TCTCTTCCGGACTGCTGTCCGGCAGATCCGACAATCACGGCGGATCCGAG

ATCGTGCTGACACAGAGCCCTGCCACCCTGTCTCTGAGCCCTGGCGAAAG

AGCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

TGTACTACTGCCAGCAGAGCAGCAACTGGCCCCGGACATTTGGCCAGGGC

ACCAAGGTGGAAATCAAG]

[Spacer (SEQ ID NO: 362)] [NV1 NV07 2001 (SEQ ID NO: 1320) Amino Acid Sequence:

(SEQ ID NO: 1321)
[QGQSGQG][YTFGCPDRYCDRAATGGGSSGGSISSGLLSGRSDNHGGSE

IVLTQSPATLSLSPGERATLSCRASQSVSSYLAWYQQKPGQAPRLLIYD

ASNRATGIPARFSGSGSGTDFTLTISSLEPEDFAVYYCQQSSNWPRTFGQ

GTKVEIK]

NV1 NV07 2001 Amino Acid Sequence:

(SEQ ID NO: 1320)
YTFGCPDRYCDRAATGGGSSGGSISSGLLSGRSDNHGGSEIVLTQS

PATLSLSPGERATLSCRASQSVSSYLAWYQQKPGQAPRLLIYDASNR

ATGIPARFSGSGSGTDFTLTISSLEPEDFAVYYCQQSSNWPRTFGQG

TKVEIK

[Spacer (SEQ ID NO: 918)] [NV1 NV07 2001 (SEQ ID NO: 1322)] Nucleotide Sequence:

(SEQ ID NO: 1323)
[CAAGGCCAGTCTGGCCAAGGT][TATACGTTTGGTTGCCCTGATAGG

TATTGCGATCGTGCGGCGACGGGAGGTGGCTCGAGCGGCGGCTCTATCT

CTTCCGGACTGCTGTCCGGCAGATCCGACAATCACGGCGGATCCGAGAT

CGTGCTGACACAGAGCCCTGCCACCCTGTCTCTGAGCCCTGGCGAAAGAG

CCACCCTGAGCTGTAGAGCCAGCCAGAGCGTGTCCAGCTACCTGGCCTGG

TATCAGCAGAAGCCCGGCCAGGCTCCCCGGCTGCTGATCTACGATGCCAG

CAATAGAGCCACCGGCATCCCCGCCAGATTTTCCGGCTCTGGCAGCGGCA

CCGACTTCACCCTGACCATCAGCTCCCTGGAACCCGAGGACTTCGCCGTG

TACTACTGCCAGCAGAGCAGCAACTGGCCCCGGACATTTGGCCAGGGCAC

CAAGGTGGAAATCAAG]

[Spacer (SEQ ID NO: 362)] [NV1 NV08 2001 (SEQ ID NO: 1324) Amino Acid Sequence:

(SEQ ID NO: 1325)
[QGQSGQG][RGCPDFNPPSHCYTAGGGSSGGSISSGLLSGRSDNHGGSE

IVLTQSPATLSLSPGERATLSCRASQSVSSYLAWYQQKPGQAPRLLIYDA

SNRATGIPARFSGSGSGTDFTLTISSLEPEDFAVYYCQQSSNWPRTFGQG

TKVEIK]

NV1 NV08 2001 Amino Acid Sequence:

(SEQ ID NO: 1324)
RGCPDFNPPSHCYTAGGGSSGGSISSGLLSGRSDNHGGSEIVLTQSPA

TLSLSPGERATLSCRASQSVSSYLAWYQQKPGQAPRLLIYDASNRATGI

PARFSGSGSGTDFTLTISSLEPEDFAVYYCQQSSNWPRTFGQGTKVEIK

[Spacer (SEQ ID NO: 918)] [NV1 NV08 2001 (SEQ ID NO: 1326)] Nucleotide Sequence:

(SEQ ID NO: 1327)
[CAAGGCCAGTCTGGCCAAGGT][CGTGGTTGTCCGGATTTTAATCCTCC

TTCTCATTGCTATACTGCTGGAGGTGGCTCGAGCGGCGGCTCTATCTCTT

CCGGACTGCTGTCCGGCAGATCCGACAATCACGGCGGATCCGAGATCGT

GCTGACACAGAGCCCTGCCACCCTGTCTCTGAGCCCTGGCGAAAGAGCC

ACCCTGAGCTGTAGAGCCAGCCAGAGCGTGTCCAGCTACCTGGCCTGGTA

TCAGCAGAAGCCCGGCCAGGCTCCCCGGCTGCTGATCTACGATGCCAGC

AATAGAGCCACCGGCATCCCCGCCAGATTTTCCGGCTCTGGCAGCGGCAC

CGACTTCACCCTGACCATCAGCTCCCTGGAACCCGAGGACTTCGCCGTGT

ACTACTGCCAGCAGAGCAGCAACTGGCCCCGGACATTTGGCCAGGGCAC

CAAGGTGGAAATCAAG]

[Spacer (SEQ ID NO: 362)] [NV1 NV09 2001 (SEQ ID NO: 1328) Amino Acid Sequence:

(SEQ ID NO: 1329)
[QGQSGQG][RDYCGPQSPDYCHEIGGGSSGGSISSGLLSGRSDNHGG
SEIVLTQSPATLSLSPGERATLSCRASQSVSSYLAWYQQKPGQAPRLLIY
DASNRATGIPARFSGSGSGTDFTLTISSLEPEDFAVYYCQQSSNWPRTFG
QGTKVEIK]

NV1 NV09 2001 Amino Acid Sequence:

(SEQ ID NO: 1328)
RDYCGPQSPDYCHEIGGGSSGGSISSGLLSGRSDNHGGSEIVLTQSPA
TLSLSPGERATLSCRASQSVSSYLAWYQQKPGQAPRLLIYDASNRATGI
PARFSGSGSGTDFTLTISSLEPEDFAVYYCQQSSNWPRTFGQGTKVEIK

[Spacer (SEQ ID NO: 918)] [NV1 NV09 2001 (SEQ ID NO: 1330)] Nucleotide Sequence:

(SEQ ID NO: 1331)
[CAAGGCCAGTCTGGCCAAGGT][AGGGATTATTGCGGGCCTCAGAGTCC
TGATTATTGCCATGAGATTGGAGGTGGCTCGAGCGGCGGCTCTATCTCTT
CCGGACTGCTGTCCGGCAGATCCGACAATCACGGCGGATCCGAGATCGT
GCTGACACAGAGCCCTGCCACCCTGTCTCTGAGCCCTGGCGAAAGAGCC
ACCCTGAGCTGTAGAGCCAGCCAGAGCGTGTCCAGCTACCTGGCCTGGTA
TCAGCAGAAGCCCGGCCAGGCTCCCCGGCTGCTGATCTACGATGCCAGCA
ATAGAGCCACCGGCATCCCCGCCAGATTTTCCGGCTCTGGCAGCGGCACC
GACTTCACCCTGACCATCAGCTCCCTGGAACCCGAGGACTTCGCCGTGTA
CTACTGCCAGCAGAGCAGCAACTGGCCCCGGACATTTGGCCAGGGCACCA
AGGTGGAAATCAAG]

[Spacer (SEQ ID NO: 362)] [NV1 NV10 2001 (SEQ ID NO: 1332) Amino Acid Sequence:

(SEQ ID NO: 1333)
[QGQSGQG][PNKPCPDLQCYVTNYGGGSSGGSISSGLLSGRSDNHGG
SEIVLTQSPATLSLSPGERATLSCRASQSVSSYLAWYQQKPGQAPRLLIY
DASNRATGIPARFSGSGSGTDFTLTISSLEPEDFAVYYCQQSSNWPRTFG
QGTKVEIK]

NV1 NV10 2001 Amino Acid Sequence:

(SEQ ID NO: 1332)
PNKPCPDLQCYVTNYGGGSSGGSISSGLLSGRSDNHGGSEIVLTQSPA
TLSLSPGERATLSCRASQSVSSYLAWYQQKPGQAPRLLIYDASNRATGI
PARFSGSGSGTDFTLTISSLEPEDFAVYYCQQSSNWPRTFGQGTKVEIK

[Spacer (SEQ ID NO: 918)] [NV1 NV10 2001 (SEQ ID NO: 1334)] Nucleotide Sequence:

(SEQ ID NO: 1335)
[CAAGGCCAGTCTGGCCAAGGT][CCGAATAAGCCTTGCCCGGATCTGC
AGTGCTATGTGACGAATTATGGAGGTGGCTCGAGCGGCGGCTCTATCTCT
TCCGGACTGCTGTCCGGCAGATCCGACAATCACGGCGGATCCGAGATCG
TGCTGACACAGAGCCCTGCCACCCTGTCTCTGAGCCCTGGCGAAAGAGCC
ACCCTGAGCTGTAGAGCCAGCCAGAGCGTGTCCAGCTACCTGGCCTGGTA
TCAGCAGAAGCCCGGCCAGGCTCCCCGGCTGCTGATCTACGATGCCAGC
AATAGAGCCACCGGCATCCCCGCCAGATTTTCCGGCTCTGGCAGCGGCAC
CGACTTCACCCTGACCATCAGCTCCCTGGAACCCGAGGACTTCGCCGTGT
ACTACTGCCAGCAGAGCAGCAACTGGCCCCGGACATTTGGCCAGGGCACC
AAGGTGGAAATCAAG]

[Spacer (SEQ ID NO: 362)] [NV1 NV11 2001 (SEQ ID NO: 1336) Amino Acid Sequence:

(SEQ ID NO: 1337)
[QGQSGQG][PRVACGEPDLCYSNTGGGSSGGSISSGLLSGRSDNHGG
SEIVLTQSPATLSLSPGERATLSCRASQSVSSYLAWYQQKPGQAPRLLIY
DASNRATGIPARFSGSGSGTDFTLTISSLEPEDFAVYYCQQSSNWPRTF
GQGTKVEIK]

NV1 NV11 2001 Amino Acid Sequence:

(SEQ ID NO: 1336)
PRVACGEPDLCYSNTGGGSSGGSISSGLLSGRSDNHGGSEIVLTQSPA
TLSLSPGERATLSCRASQSVSSYLAWYQQKPGQAPRLLIYDASNRATGI
PARFSGSGSGTDFTLTISSLEPEDFAVYYCQQSSNWPRTFGQGTKVEIK

[Spacer (SEQ ID NO: 918)] [NV1 NV11 2001 (SEQ ID NO: 1338)] Nucleotide Sequence:

(SEQ ID NO: 1339)
[CAAGGCCAGTCTGGCCAAGGT][CCGCGGGTTGCTTGCGGTGAGCCT
GATCTTTGCTATTCTAATACTGGAGGTGGCTCGAGCGGCGGCTCTATCTC
TTCCGGACTGCTGTCCGGCAGATCCGACAATCACGGCGGATCCGAGATC
GTGCTGACACAGAGCCCTGCCACCCTGTCTCTGAGCCCTGGCGAAAGAGC
CACCCTGAGCTGTAGAGCCAGCCAGAGCGTGTCCAGCTACCTGGCCTGGT
ATCAGCAGAAGCCCGGCCAGGCTCCCCGGCTGCTGATCTACGATGCCAGC
AATAGAGCCACCGGCATCCCCGCCAGATTTTCCGGCTCTGGCAGCGGCAC
CGACTTCACCCTGACCATCAGCTCCCTGGAACCCGAGGACTTCGCCGTGT
ACTACTGCCAGCAGAGCAGCAACTGGCCCCGGACATTTGGCCAGGGCAC
CAAGGTGGAAATCAAG]

[Spacer (SEQ ID NO: 362)] [NV1 NV12 2001 (SEQ ID NO: 1340) Amino Acid Sequence:

(SEQ ID NO: 1341)
[QGQSGQG][RGCKKHTISTLTCPDGGGSSGGSISSGLLSGRSDNHGG
SEIVLTQSPATLSLSPGERATLSCRASQSVSSYLAWYQQKPGQAPRLLIY
DASNRATGIPARFSGSGSGTDFTLTISSLEPEDFAVYYCQQSSNWPRTFG
QGTKVEIK]

NV1 NV12 2001 Amino Acid Sequence:

(SEQ ID NO: 1340)
RGCKKHTISTLTCPDGGGSSGGSISSGLLSGRSDNHGGSEIVLTQSPATL

SLSPGERATLSCRASQSVSSYLAWYQQKPGQAPRLLIYDASNRATGIPAR

FSGSGSGTDFTLTISSLEPEDFAVYYCQQSSNWPRTFGQGTKVEIK

[Spacer (SEQ ID NO: 918)] [NV1 NV12 2001 (SEQ ID NO: 1342)] Nucleotide Sequence:

(SEQ ID NO: 1343)
[CAAGGCCAGTCTGGCCAAGGT][CGGGGGTGCAAGAAGCATACTATT

TCGACGCTTACGTGCCCTGATGGAGGTGGCTCGAGCGGCGGCTCTA

TCTCTTCCGGACTGCTGTCCGGCAGATCCGACAATCACGGCGGATCCGAG

ATCGTGCTGACACAGAGCCCTGCCACCCTGTCTCTGAGCCCTGGCGAAAG

AGCCACCCTGAGCTGTAGAGCCAGCCAGAGCGTGTCCAGCTACCTGGCCT

GGTATCAGCAGAAGCCCGGCCAGGCTCCCCGGCTGCTGATCTACGATGCC

AGCAATAGAGCCACCGGCATCCCCGCCAGATTTTCCGGCTCTGGCAGCGG

CACCGACTTCACCCTGACCATCAGCTCCCTGGAACCCGAGGACTTCGCCG

TGTACTACTGCCAGCAGAGCAGCAACTGGCCCCGGACATTTGGCCAGGGC

ACCAAGGTGGAAATCAAG]

Human Kappa Constant (SEQ ID NO: 1344)
RTVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVTK

SFNRGEC

Human Kappa Constant (SEQ ID NO: 1345)
CGTACGGTGGCTGCACCATCTGTCTTCATCTTCCCGCCATCTGATGAGCA

GTTGAAATCTGGAACTGCCTCTGTTGTGTGCCTGCTGAATAACTTCTATC

CCAGAGAGGCCAAAGTACAGTGGAAGGTGGATAACGCCCTCCAATCGGGT

AACTCCCAGGAGAGTGTCACAGAGCAGGACAGCAAGGACAGCACCTACAG

CCTCAGCAGCACCCTGACGCTGAGCAAAGCAGACTACGAGAAACACAAAG

TCTACGCCTGCGAAGTCACCCATCAGGGCCTGAGCTCGCCCGTCACAAAG

AGCTTCAACAGGGGAGAGTGT

NV1 HC Variable (SEQ ID NO: 1346)
QVQLVESGGGVVQPGRSLRLDCKAS<u>GITFSNSGMH</u>WVRQAPGKGLEWVAV <u>IWYDGSKR</u>YYADSVKGRFTISRDNSKNTLFLQMNSLRAEDTAVYYCA<u>TND</u>

<u>DY</u>WGQGTLVTVSS

NV1 HC Variable (SEQ ID NO: 1347)
CAGGTGCAGCTGGTGGAATCTGGCGGCGGAGTGGTGCAGCCTGGCAGAAG

CCTGAGACTGGACTGCAAGGCCAGCGGCATCACCTTCAGCAACAGCGGCA

TGCACTGGGTGCGCCAGGCCCCTGGAAAAGGCCTGGAATGGGTGGCCGTG

ATTTGGTACGACGGCAGCAAGCGGTACTACGCCGACAGCGTGAAGGGCCG

GTTCACCATCAGCCGGGACAACAGCAAGAATACCCTGTTCCTGCAGATGA

ACAGCCTGCGGGCCGAGGACACCGCCGTGTACTACTGCGCCACCAACGAC

GACTATTGGGGCCAGGGCACACTCGTGACCGTGTCCTCT hIgG4 S228P Constant (SEQ ID NO: 1348)
ASTKGPSVFPLAPCSRSTSESTAALGCLVKDYFPEPVTVSWNSGALTSGV

HTFPAVLQSSGLYSLSSVVTVPSSSLGTKTYTCNVDHKPSNTKVDKRVES

KYGPPCPPCPAPEFLGGPSVFLFPPKPKDTLMISRTPEVTCVVVDVSQED

PEVQFNWYVDGVEVHNAKTKPREEQFNSTYRVVSVLTVLHQDWLNGKEYK

CKVSNKGLPSSIEKTISKAKGQPREPQVYTLPPSQEEMTKNQVSLTCLVK

GFYPSDIAVEWESNGQPENNYKTTPPVLDSDGSFFLYSRLTVDKSRWQEG

NVFSCSVMHEALHNHYTQKSLSLSLGK hIgG4 S228P Constant (SEQ ID NO: 1349)
GCTAGCACCAAGGGCCCATCGGTCTTCCCCCTGGCACCCTGTAGCAGAAG

CACCAGCGAGTCTACAGCGGCCCTGGGCTGCCTGGTCAAGGACTACTTCC

CCGAACCGGTGACGGTGTCGTGGAACTCAGGCGCCCTGACCAGCGGCGTG

CACACCTTCCCGGCTGTCCTACAGTCCTCAGGACTCTACTCCCTCAGCAG

CGTGGTGACCGTGCCCTCCAGCAGCTTGGGCACCAAGACCTACACCTGTA

ACGTGGACCACAAGCCCAGCAACACCAAGGTGGACAAGCGGGTGGAATCT

AAGTACGGCCCTCCCTGCCCTCCTTGCCCAGCCCCTGAATTTCTGGGGGG

ACCGTCAGTCTTCCTCTTCCCCCCAAAACCCAAGGACACCCTCATGATCT

CCCGGACCCCTGAGGTCACATGCGTGGTGGTGGACGTGAGCCAGGAAGAC

CCTGAGGTCCAGTTCAACTGGTACGTGGACGGCGTGGAGGTGCATAATGC

CAAGACAAAGCCGCGGGAGGAGCAGTTCAACAGCACGTACCGTGTGGTCA

GCGTCCTCACCGTCCTGCACCAGGACTGGCTGAATGGCAAGGAGTACAAG

TGCAAGGTCTCCAACAAAGGCCTGCCCAGCTCCATCGAGAAAACCATCTC

CAAAGCCAAAGGGCAGCCCCGAGAACCACAGGTGTACACCCTGCCCCCAT

CCCAGGAGGAGATGACCAAGAACCAGGTCAGCCTGACCTGCCTGGTCAAA

GGCTTCTATCCCAGCGACATCGCCGTGGAGTGGGAGAGCAATGGGCAGCC

GGAGAACAACTACAAGACCACGCCTCCCGTGCTGGACTCCGACGGCTCCT

TCTTCCTCTACAGCAGACTCACCGTGGACAAGAGCAGGTGGCAGGAAGGG

AACGTCTTCTCATGCTCCGTGATGCATGAGGCTCTGCACAACCACTACAC

GCAGAAGAGCCTCTCCCTGTCTCTGGGTAAA

Example 21: Characterization of Activatable Anti-PD1 NV1 Antibodies

This example describes activatable anti-PD1 NV1 antibodies with reduced binding to hPD1.

Figure 26B:
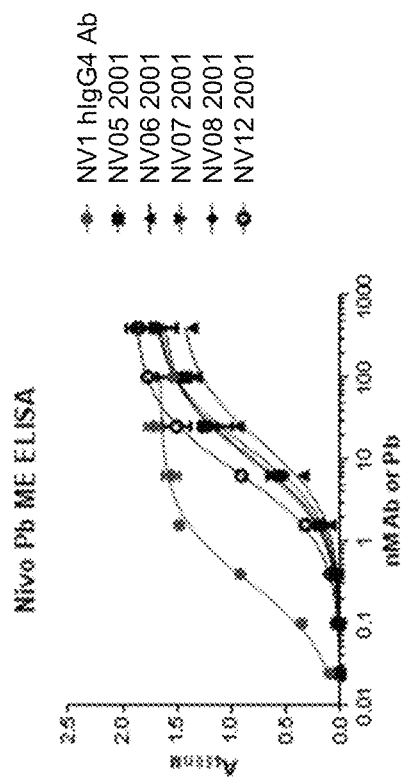
FIGS. 26A, 26B, and 26C are a series of graphs depicting the binding to hPD-1 by the anti-PD-1 antibody nivolumab (NV1) and by of various activatable antibodies of the disclosure comprising the anti-PD1 antibody NV1, the substrate referred to herein as 2001 (SEQ ID NO: 214), and the masking moieties referred to herein NV01 (SEQ ID NO: 1206), NV02 (SEQ ID NO: 1207), NV03 (SEQ ID NO: 1208), NV04 (SEQ ID NO: 1209), NV05 (SEQ ID NO: 1210), NV06 (SEQ ID NO: 1211), NV07 (SEQ ID NO: 1212), NV08 (SEQ ID NO: 1213), NV09 (SEQ ID NO: 1214), NV10 (SEQ ID NO: 1215), NV11 (SEQ ID NO: 1216), and NV12 (SEQ ID NO: 1217).
Figure 26A:
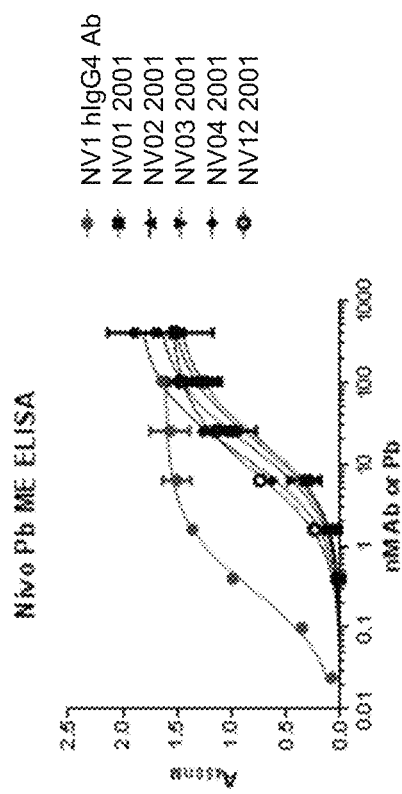
Figure 26C:
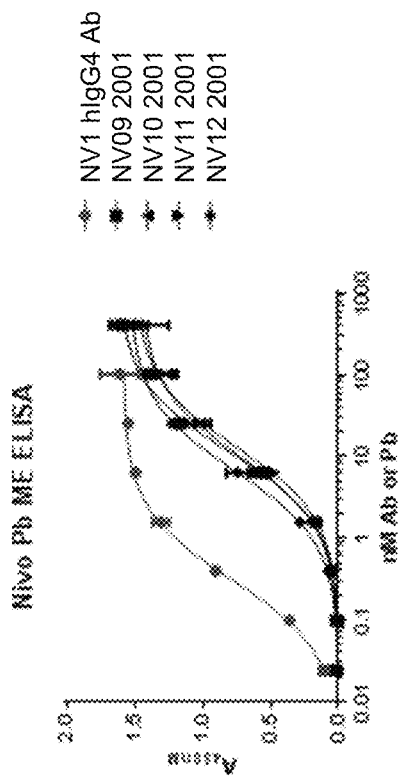

Masking efficiencies were evaluated by standard plate ELISA. Briefly, human PD1-Fc (R and D systems, Minneapolis, Minn.) was adsorbed to the wells of a 96-well ELISA plate. Purified NV1 and activatable NV1 antibodies were applied to the plate in serial dilution and allowed to bind. Bound antibody and activatable antibodies were detected with anti-hu Fab-HRP conjugate (Sigma, St Louis, Mo.) and visualized with the chromogenic substrate TMB (Thermo Scientific, Rockford, Ill.). Plots were generated in Prizm (Sigma Plot). All activatable NV1 antibodies showed decreased binding compared with the parental NV1, as shown in FIG. 26.

Example 22: Activatable Anti-PD1 Pembrolizumab Masking Moieties

This example describes identification of masking moieties (MM) that reduce binding of anti-PD1 pembrolizumab antibody to its target.

Anti-PD1 Pembrolizumab (PM1) (see, e.g., U.S. Pat. No. 8,354,509) was used to screen libraries using a method similar to that described in PCT International Publication Number WO 2010/081173, published 15 Jul. 2010. The screening consisted of one round of MACS and three rounds of FACS sorting. For the initial MACS, approximately $1.6 \times 10^{12}$ cells were incubated with PM1 antibody at a concentration of 200 nM, and approximately $8 \times 10^6$ binders were collected using Protein-A Dynabeads (Life Technologies, Carlsbad, Calif.). FACS rounds were conducted labeling cells with DyLight 650 (Thermo-Fisher) labeled PM1 antibody and collecting cells with strongest fluorescence as follows: 100 nM PM1-650 collecting brightest 10% for FACS round 1 ($5.6 \times 10^5$ for F1), 10 nM PM1-650 collecting brightest 1.5% for FACS round 2 ($1.4 \times 10^4$ for F2), 1 nM PM1-650 collecting all binders above background (4,000) and the top 0.2% (820) for FACS round 3 (F3). Individual peptide clones from the two F3 populations were identified by sequence analysis (Table 20), and selected peptide clones PM01-PM12 were subsequently verified for their ability to bind PM1 (masking moiety PM001 is also referred to herein as PM01 and/or PM-01; masking moiety PM002 is also referred to herein as PM02 and/or PM-02, and so on).

TABLE 20

| Mask | Amino Acid Sequence | SEQ ID NO: |
| --- | --- | --- |
| PM01 | GCDFTSAKHNCGSGW | 1351 |
| PM02 | VGSNCWTGPACALTS | 1352 |
| PM03 | FCAVMFDFLSDRCLH | 1353 |
| PM04 | FCPPWLDYLGNKCMT | 1354 |
| PM05 | MSCWDFSSAQGCGQH | 1355 |
| PM06 | LMCADLHYNHYNCKY | 1356 |
| PM07 | ELCGWQSFSGVCTSE | 1357 |
| PM08 | WTYENCWASCQPHLE | 1358 |
| PM09 | KLTEDFSSAA | 1359 |

TABLE 20-continued

| Mask | Amino Acid Sequence | SEQ ID NO: |
| --- | --- | --- |
| PM10 | VGQSCFSGLVCDRQL | 1360 |
| PM11 | ISHYCFSGKSCRD | 1361 |
| PM12 | HCIPDFTSAAGDCMR | 1362 |
| PM13 | RLVSAYSFS | 1363 |
| PM14 | KFHHSHPLVHDFTSA | 1364 |
| PM15 | ASYPDFSSANGVGLR | 1365 |
| PM16 | GLATTLSNVDFTSAG | 1366 |
| PM17 | DFTSANSAFSGDAST | 1367 |
| PM18 | GRLPGHSVVDFTSAW | 1368 |
| PM19 | SGSFYSSSAFDFTSA | 1369 |
| PM20 | CDDFTSAQHSRINEC | 1370 |
| PM21 | CDFTSAQGKKCRTAL | 1371 |
| PM22 | YYIDKYQSPSYGPVL | 1372 |
| PM23 | FSVARARSSADFTSS | 1373 |
| PM24 | DSDFTSAGSADSRSR | 1374 |
| PM25 | CDFTSATSISKRCDH | 1375 |
| PM26 | IESSASSWGLQASRN | 1376 |
| PM27 | PRYHNLNFTTPALSPGS | 1377 |
| PM28 | DLFARFPLDRDFTSA | 1378 |
| PM29 | HCNFTTPPYCSSTLW | 1379 |
| PM30 | NVPIILLTDRQLLSG | 1380 |
| PM31 | NPTACDFTSSMATYC | 1381 |
| PM32 | FVRTVRFSNSMFSVP | 1382 |
| PM33 | YDFSSASNSSPSRQT | 1383 |
| PM34 | AHPDFSSAMRGNLLG | 1384 |
| PM35 | SSHVVHKDFTSANSR | 1385 |
| PM36 | CPDFTSANGGGCWQM | 1386 |
| PM37 | SLGQSYPTDFTCPGC | 1387 |
| PM38 | ASMRSHEQRDFTSAY | 1388 |
| PM39 | SCQFWFTLCSGGVFH | 1389 |
| PM40 | PYPNNRTGMHDFTSA | 1390 |
| PM41 | KPFPIDFTSAGTSGT | 1391 |
| PM42 | SIKSFIPRDDFTSAA | 1392 |
| PM43 | GIKNPATPFVDFTSA | 1393 |
| PM44 | LSHTYPRGSSTIEAS | 1394 |
| P TABLE 20-continued

| Mask | Amino Acid Sequence | SEQ ID NO: |
|---|---|---|
| PM49 | VSVECFSGMQCPHYY | 1399 |
| PM50 | ASKCRLPCMASTQIY | 1400 |
| PM51 | GLRSCNIYFSIPCTY | 1401 |
| PM52 | RGTSDGTLDFTTARS | 1402 |
| PM53 | SMYPSASRLLHPQYP | 1403 |
| PM54 | HCISCYDFTSAAGSF | 1404 |
| PM55 | SSGRWGDAWACARIC | 1405 |
| PM56 | RVFSDFTSASHSFGG | 1406 |
| PM57 | TDRHSASGRDFTSAH | 1407 |
| PM58 | AHCEDFSSAERIATMGC | 1408 |
| PM59 | ACDPYSFSIPCDDRL | 1409 |
| PM60 | NSPFTLSHIYDR | 1410 |
| PM61 | IGTNFTTPSAFVAPP | 1411 |
| PM62 | RDAFPIYRNADFSTP | 1412 |
| PM63 | SIPNASSYNFTSSSG | 1413 |
| PM64 | AGIPDKRHTYDFTSA | 1414 |
| PM65 | WPLAHDSRDWNFTTP | 1415 |
| PM66 | RHSPSSGHVDFTSAG | 1416 |
| PM67 | SCFAWTDPVWNRCSW | 1417 |
| PM68 | MPCDWTGPGKIWCGG | 1418 |
| PM69 | RDCDFSTANFRSCNK | 1419 |
| PM70 | LSCVVSPNYLHCNDH | 1420 |
| PM71 | FVCGLYSFSGVCQGV | 1421 |
| PM72 | IGLMCFSGLQCPMLA | 1422 |
| PM73 | PGMNCFSGEICQMST | 1423 |
| PM74 | GDVGSCWASCGLQGG | 1424 |
| PM75 | SQFQDCWASCGASFT | 1425 |
| PM76 | VGSLNCWYSCGDIWL | 1426 |
| PM77 | MCESWLNFLGDQCGM | 1427 |
| PM78 | RCMISQSSFSGMCGM | 1428 |
| PM79 | NCAPWTSNMSNHCLK | 1429 |
| PM80 | LCGVGSATGLELCGV | 1430 |
| PM81 | GCDFSSLGGRQPCTP | 1431 |
| PM82 | MGCNFTTYPYHTCNT | 1432 |
| PM83 | GSCDFTSGAGKKCGS | 1433 |
| PM84 | VSCDFTSSHARMCSR | 1434 |
| PM85 | MRCTDFYYNHTNCIG | 1435 |
| PM86 | RSCDFTSAANKYCAT | 1436 |
| PM87 | LYCDSFSVPRPNCAP | 1437 |
| PM88 | NSCDFTSARVSKCST | 1438 |
| PM89 | STCSDNFTTPMPCNT | 1439 |
| PM90 | DICNDRPNLTHCHYF | 1440 |
| PM91 | LRCDDFTSAIGCRGY | 1441 |
| PM92 | EGCDFTSALHSCNNY | 1442 |
| PM93 | RKGCGDFTSASCFVV | 1443 |
| PM94 | GMLCAGSSFGLCESM | 1444 |
| PM95 | RESCFGSSLGLCTNK | 1445 |
| PM96 | ILRCYDIPTNCMNFN | 1446 |
| PM97 | NSECTFGAMYCRNKP | 1447 |
| PM98 | ASGCFDEDIRCSGGA | 1448 |
| PM99 | HYFCNQSNPSCQTAP | 1449 |
| PM100 | AMGCELGGAGCIGSP | 1450 |
| PM101 | TLKCHMPRKLCANDP | 1451 |
| PM102 | RPACRDLPHNCITST | 1452 |
| PM103 | QMSCHGNFTTCHSNP | 1453 |
| PM104 | LTGCARGARPCRLRV | 1454 |
| PM105 | WSELCLAGPSCGWVG | 1455 |
| PM106 | VTKSCWQLPHCITAP | 1456 |
| PM107 | KAASCPHNQICNMTA | 1457 |
| PM108 | VSKNCFSGMMCPVFA | 1458 |
| PM109 | NRSSCWTGPTCHVLH | 1459 |
| PM110 | ARTGCSGPVCLNDVS | 1460 |
| PM111 | STRTCLAFTCINGNT | 1461 |
| PM112 | MLDGNCWYACSYKNT | 1462 |
| PM113 | FSRSDCWSACAPWRV | 1463 |
| PM114 | GGRMDCWASCQPLSR | 1464 |
| PM115 | NSPHSCMTNCDFTSA | 1465 |

Example 23: Activatable Anti-PD1 Pembrolizumab Antibodies

This example describes examples of activatable anti-PD1 Pembrolizumab antibodies of the disclosure.

Activatable anti-PD1 PM1 antibodies comprising an anti-PD1 PM1 masking moiety, a cleavable moiety, and an anti-PD1 PM1 antibody of the disclosure were produced according to methods similar to those described in PCT Publication Nos. WO 2009/025846 and WO 2010/081173. One embodiment of the disclosure is an anti-PD-1 activatable antibody comprising a heavy chain comprising amino acid sequence SEQ ID NO: 1514. One embodiment of the disclosure is an anti-PD-1 activatable antibody comprising a light chain comprising amino acid sequence SEQ ID NO: 638. One embodiment of the disclosure is an anti-PD-1 activatable antibody comprising a heavy chain comprising amino acid sequence SEQ ID NO: 1514 and a light chain comprising amino acid sequence SEQ ID NO: 638. One embodiment of the disclosure is an anti-PD-1 activatable antibody comprising the CDRs of an anti-PD-1 activatable antibody comprising a heavy chain comprising amino acid sequence SEQ ID NO: 1514 and a light chain comprising amino acid sequence SEQ ID NO: 638.

The amino acid and nucleic acid sequences of several activatable anti-PD1 antibody variable domains of the disclosure are provided below. Antibodies were produced as hIgG4 containing a single amino acid substitution, S228P (Angal, et al. 1993. Mol Immunol 30:105-8.) HC and hK LC format.

PM1 Light Chain Amino Acid Sequence:

(SEQ ID NO: 638)
EIVLTQSPATLSLSPGERATLSCRAS<u>KGVSTSGYSY</u>LHWYQQKPGQAPRL

LIY<u>LAS</u>YLESGVPARFSGSGSGTDFTLTISSLEPEDFAVYYC<u>QHSRDLPL</u>

<u>T</u>FGGGTKVEIK

[Spacer (SEQ ID NO: 362)] [PM1 PM01 2001 (SEQ ID NO: 1466)] Amino Acid Sequence:

(SEQ ID NO: 1467)
[QGQSGQG][CDFTSAKHNCGSGWGSSGGSISSGLLSGRSDNHGGSEI

VLTQSPATLSLSPGERATLSCRASKGVSTSGYSYLHWYQQKPGQAPRLLI

YLASYLESGVPARFSGSGSGTDFTLTISSLEPEDFAVYYCQHSRDLPLTF

GGGTKVEIK]

PM1 PM01 2001 Amino Acid Sequence:

(SEQ ID NO: 1466)
CDFTSAKHNCGSGWGSSGGSISSGLLSGRSDNHGGSEIVLTQSPATLSLS

PGERATLSCRASKGVSTSGYSYLHWYQQKPGQAPRLLIYLASYLESGVPA

RFSGSGSGTDFTLTISSLEPEDFAVYYCQHSRDLPLTFGGGTKVEIK

[Spacer (SEQ ID NO: 1126)] [PM1 PM01 2001 (SEQ ID NO: 1468)] Nucleotide Sequence:

(SEQ ID NO: 1469)
[CAAGGCCAGTCTGGCCAAGGA][TGCGATTTTACTTCTGCCAAGCAC

AATTGCGGCTCTGGCTGGGGCTCGAGCGGCGGCTCTATCTCTTCCGGACT

GCTGTCCGGCAGATCCGACAATCACGGCGGATCCGAGATCGTGCTGACAC

AGAGCCCTGCCACCCTGTCTCTGAGCCCTGGCGAAAGAGCCACCCTGAGC

TGTAGAGCCTCTAAGGGCGTGTCCACCAGCGGCTACAGCTACCTGCACTG

GTATCAGCAGAAGCCCGGCCAGGCCCCCAGACTGCTGATCTACCTGGCCT

CCTACCTGGAAAGCGGCGTGCCCGCCAGATTTTCTGGCTCTGGCAGCGGC

ACCGACTTCACCCTGACAATCAGCAGCCTGGAACCCGAGGACTTCGCCGT

GTACTACTGCCAGCACAGCAGGGACCTGCCCCTGACATTTGGCGGAGGCA

CCAAGGTGGAAATCAAG]

[Spacer (SEQ ID NO: 362)] [PM1 PM02 2001 (SEQ ID NO: 1470)] Amino Acid Sequence:

(SEQ ID NO: 1471)
[QGQSGQG][VGSNCWTGPACALTSGGGSSGGSISSGLLSGRSDNHGG

SEIVLTQSPATLSLSPGERATLSCRASKGVSTSGYSYLHWYQQKPGQAPR

LLIYLASYLESGVPARFSGSGSGTDFTLTISSLEPEDFAVYYCQHSRDLP

LTFGGGTKVEIK]

PM1 PM02 2001 Amino Acid Sequence:

(SEQ ID NO: 1470)
VGSNCWTGPACALTSGGGSSGGSISSGLLSGRSDNHGGSEIVLTQSPATL

SLSPGERATLSCRASKGVSTSGYSYLHWYQQKPGQAPRLLIYLASYLESG

VPARFSGSGSGTDFTLTISSLEPEDFAVYYCQHSRDLPLTFGGGTKVEIK

[Spacer (SEQ ID NO: 918)] [PM1 PM02 2001 (SEQ ID NO: 1472)] Nucleotide Sequence:

(SEQ ID NO: 1473)
[CAAGGCCAGTCTGGCCAAGGT][GTTGGGTCGAATTGCTGGACGGGGCC

GGCGTGCGCTTTGACGTCGGGAGGTGGCTCGAGCGGCGGCTCTATCTCTT

CCGGACTGCTGTCCGGCAGATCCGACAATCACGGCGGATCCGAGATCGTG

CTGACACAGAGCCCTGCCACCCTGTCTCTGAGCCCTGGCGAAAGAGCCAC

CCTGAGCTGTAGAGCCTCTAAGGGCGTGTCCACCAGCGGCTACAGCTACC

TGCACTGGTATCAGCAGAAGCCCGGCCAGGCCCCCAGACTGCTGATCTAC

CTGGCCTCCTACCTGGAAAGCGGCGTGCCCGCCAGATTTTCTGGCTCTGG

CAGCGGCACCGACTTCACCCTGACAATCAGCAGCCTGGAACCCGAGGACT

TCGCCGTGTACTACTGCCAGCACAGCAGGGACCTGCCCCTGACATTTGGC

GGAGGCACCAAGGTGGAAATCAAG]

[Spacer (SEQ ID NO: 362)] [PM1 PM03 2001 (SEQ ID NO: 1474)] Amino Acid Sequence:

(SEQ ID NO: 1475)
[QGQSGQG][FCAVMFDFLSDRCLHGGGSSGGSISSGLLSGRSDNHGGSE

IVLTQSPATLSLSPGERATLSCRASKGVSTSGYSYLHWYQQKPGQAPRLL

IYLASYLESGVPARFSGSGSGTDFTLTISSLEPEDFAVYYCQHSRDLPLT

FGGGTKVEIK]

PM1 PM03 2001 Amino Acid Sequence:

(SEQ ID NO: 1474)
FCAVMFDFLSDRCLHGGGSSGGSISSGLLSGRSDNHGGSEIVLTQSPATL

SLSPGERATLSCRASKGVSTSGYSYLHWYQQKPGQAPRLLIYLASYLESG

VPARFSGSGSGTDFTLTISSLEPEDFAVYYCQHSRDLPLTFGGGTKVEIK

[Spacer (SEQ ID NO: 918)] [PM1 PM03 2001 (SEQ ID NO: 1476)] Nucleotide Sequence:

(SEQ ID NO: 1477)
[CAAGGCCAGTCTGGCCAAGGT][TTTTGCGCTGTGATGTTTGATTTTCT

GTCTGATCGGTGCCTGCATGGAGGTGGCTCGAGCGGCGGCTCTATCTCTT

-continued

```
CCGGACTGCTGTCCGGCAGATCCGACAATCACGGCGGATCCGAGATCGTG
CTGACACAGAGCCCTGCCACCCTGTCTCTGAGCCCTGGCGAAAGAGCCAC
CCTGAGCTGTAGAGCCTCTAAGGGCGTGTCCACCAGCGGCTACAGCTACC
TGCACTGGTATCAGCAGAAGCCCGGCCAGGCCCCCAGACTGCTGATCTAC
CTGGCCTCCTACCTGGAAAGCGGCGTGCCCGCCAGATTTTCTGGCTCTGG
CAGCGGCACCGACTTCACCCTGACAATCAGCAGCCTGGAACCCGAGGACT
TCGCCGTGTACTACTGCCAGCACAGCAGGGACCTGCCCCTGACATTTGGC
GGAGGCACCAAGGTGGAAATCAAG]
```

[Spacer (SEQ ID NO: 362)] [PM1 PM04 2001 (SEQ ID NO: 1478] Amino Acid Sequence:

(SEQ ID NO: 1479)
[QGQSGQG][FCPPWLDYLGNKCMTGGGSSGGSISSGLLSGRSDNHGGSE
IVLTQSPATLSLSPGERATLSCRASKGVSTSGYSYLHWYQQKPGQAPRLL
IYLASYLESGVPARFSGSGSGTDFTLTISSLEPEDFAVYYCQHSRDLPLT
FGGGTKVEIK]

PM1 PM04 2001 Amino Acid Sequence:

(SEQ ID NO: 1478)
FCPPWLDYLGNKCMTGGGSSGGSISSGLLSGRSDNHGGSEIVLTQSPATL
SLSPGERATLSCRASKGVSTSGYSYLHWYQQKPGQAPRLLIYLASYLESG
VPARFSGSGSGTDFTLTISSLEPEDFAVYYCQHSRDLPLTFGGGTKVEIK

[Spacer (SEQ ID NO: 918)] [PM1 PM04 2001 (SEQ ID NO: 1480)] Nucleotide Sequence:

(SEQ ID NO: 1481)
[CAAGGCCAGTCTGGCCAAGGT][TTTTGCCCGCCGTGGTTGGATTATTT
GGGTAATAAGTGCATGACGGGAGGTGGCTCGAGCGGCGGCTCTATCTCTT
CCGGACTGCTGTCCGGCAGATCCGACAATCACGGCGGATCCGAGATCGTG
CTGACACAGAGCCCTGCCACCCTGTCTCTGAGCCCTGGCGAAAGAGCCAC
CCTGAGCTGTAGAGCCTCTAAGGGCGTGTCCACCAGCGGCTACAGCTACC
TGCACTGGTATCAGCAGAAGCCCGGCCAGGCCCCCAGACTGCTGATCTAC
CTGGCCTCCTACCTGGAAAGCGGCGTGCCCGCCAGATTTTCTGGCTCTGG
CAGCGGCACCGACTTCACCCTGACAATCAGCAGCCTGGAACCCGAGGACT
TCGCCGTGTACTACTGCCAGCACAGCAGGGACCTGCCCCTGACATTTGGC
GGAGGCACCAAGGTGGAAATCAAG]

[Spacer (SEQ ID NO: 362)] [PM1 PM05 2001 (SEQ ID NO: 1482)] Amino Acid Sequence:

(SEQ ID NO: 1483)
[QGQSGQG][MSCWDFSSAQGCGQHGGGSSGGSISSGLLSGRSDNHGGSE
IVLTQSPATLSLSPGERATLSCRASKGVSTSGYSYLHWYQQKPGQAPRLL
IYLASYLESGVPARFSGSGSGTDFTLTISSLEPEDFAVYYCQHSRDLPLT
FGGGTKVEIK]

PM1 PM05 2001 Amino Acid Sequence:

(SEQ ID NO: 1482)
MSCWDFSSAQGCGQHGGGSSGGSISSGLLSGRSDNHGGSEIVLTQSPATL
SLSPGERATLSCRASKGVSTSGYSYLHWYQQKPGQAPRLLIYLASYLESG
VPARFSGSGSGTDFTLTISSLEPEDFAVYYCQHSRDLPLTFGGGTKVEIK

[Spacer (SEQ ID NO: 918)] [PM1 PM05 2001 (SEQ ID NO: 1484)] Nucleotide Sequence:

(SEQ ID NO: 1485)
[CAAGGCCAGTCTGGCCAAGGT][ATGTCTTGCTGGGATTTTCTTCGGC
TCAGGGGTGCGGTCAGCATGGAGGTGGCTCGAGCGGCGGCTCTATCTCTT
CCGGACTGCTGTCCGGCAGATCCGACAATCACGGCGGATCCGAGATCGTG
CTGACACAGAGCCCTGCCACCCTGTCTCTGAGCCCTGGCGAAAGAGCCAC
CCTGAGCTGTAGAGCCTCTAAGGGCGTGTCCACCAGCGGCTACAGCTACC
TGCACTGGTATCAGCAGAAGCCCGGCCAGGCCCCCAGACTGCTGATCTAC
CTGGCCTCCTACCTGGAAAGCGGCGTGCCCGCCAGATTTTCTGGCTCTGG
CAGCGGCACCGACTTCACCCTGACAATCAGCAGCCTGGAACCCGAGGACT
TCGCCGTGTACTACTGCCAGCACAGCAGGGACCTGCCCCTGACATTTGGC
GGAGGCACCAAGGTGGAAATCAAG]

[Spacer (SEQ ID NO: 362)] [PM1 PM06 2001 (SEQ ID NO: 1486)] Amino Acid Sequence:

(SEQ ID NO: 1487)
[QGQSGQG][LMCADLHYNHYNCKYGGGSSGGSISSGLLSGRSDNHGGSE
IVLTQSPATLSLSPGERATLSCRASKGVSTSGYSYLHWYQQKPGQAPRLL
IYLASYLESGVPARFSGSGSGTDFTLTISSLEPEDFAVYYCQHSRDLPLT
FGGGTKVEIK]

PM1 PM06 2001 Amino Acid Sequence:

(SEQ ID NO: 1486)
LMCADLHYNHYNCKYGGGSSGGSISSGLLSGRSDNHGGSEIVLTQSPATL
SLSPGERATLSCRASKGVSTSGYSYLHWYQQKPGQAPRLLIYLASYLESG
VPARFSGSGSGTDFTLTISSLEPEDFAVYYCQHSRDLPLTFGGGTKVEIK

[Spacer (SEQ ID NO: 918)] [PM1 PM06 2001 (SEQ ID NO: 1488)] Nucleotide Sequence:

(SEQ ID NO: 1489)
[CAAGGCCAGTCTGGCCAAGGT][TTGATGTGCGCTGATTTGCATTATAA
TCATTATAATTGCAAGTATGGAGGTGGCTCGAGCGGCGGCTCTATCTCTT
CCGGACTGCTGTCCGGCAGATCCGACAATCACGGCGGATCCGAGATCGTG
CTGACACAGAGCCCTGCCACCCTGTCTCTGAGCCCTGGCGAAAGAGCCAC
CCTGAGCTGTAGAGCCTCTAAGGGCGTGTCCACCAGCGGCTACAGCTACC
TGCACTGGTATCAGCAGAAGCCCGGCCAGGCCCCCAGACTGCTGATCTAC
CTGGCCTCCTACCTGGAAAGCGGCGTGCCCGCCAGATTTTCTGGCTCTGG
CAGCGGCACCGACTTCACCCTGACAATCAGCAGCCTGGAACCCGAGGACT

-continued
TCGCCGTGTACTACTGCCAGCACAGCAGGGACCTGCCCCTGACATTTGGC

GGAGGCACCAAGGTGGAAATCAAG]

[Spacer (SEQ ID NO: 362)] [PM1 PM07 2001 (SEQ ID NO: 1490)] Amino Acid Sequence:

(SEQ ID NO: 1491)
[QGQSGQG][ELCGWQSFSGVCTSEGGGSSGGSISSGLLSGRSDNHGGSE

IVLTQSPATLSLSPGERATLSCRASKGVSTSGYSYLHWYQQKPGQAPRLL

IYLASYLESGVPARFSGSGSGTDFTLTISSLEPEDFAVYYCQHSRDLPLT

FGGGTKVEIK]

PM1 PM07 2001 Amino Acid Sequence:

(SEQ ID NO: 1490)
ELCGWQSFSGVCTSEGGGSSGGSISSGLLSGRSDNHGGSEIVLTQSPATL

SLSPGERATLSCRASKGVSTSGYSYLHWYQQKPGQAPRLLIYLASYLESG

VPARFSGSGSGTDFTLTISSLEPEDFAVYYCQHSRDLPLTFGGGTKVEIK

[Spacer (SEQ ID NO: 918)] [PM1 PM07 2001 (SEQ ID NO: 1492)] Nucleotide Sequence:

(SEQ ID NO: 1493)
[CAAGGCCAGTCTGGCCAAGGT][GAGTTGTGCGGTTGGCAGAGTTTTTC

GGGGGTTTGCACTAGTGAGGGAGGTGGCTCGAGCGGCGGCTCTATCTCTT

CCGGACTGCTGTCCGGCAGATCCGACAATCACGGCGGATCCGAGATCGTG

CTGACACAGAGCCCTGCCACCCTGTCTCTGAGCCCTGGCGAAAGAGCCAC

CCTGAGCTGTAGAGCCTCTAAGGGCGTGTCCACCAGCGGCTACAGCTACC

TGCACTGGTATCAGCAGAAGCCCGGCCAGGCCCCCAGACTGCTGATCTAC

CTGGCCTCCTACCTGGAAAGCGGCGTGCCCGCCAGATTTTCTGGCTCTGG

CAGCGGCACCGACTTCACCCTGACAATCAGCAGCCTGGAACCCGAGGACT

TCGCCGTGTACTACTGCCAGCACAGCAGGGACCTGCCCCTGACATTTGGC

GGAGGCACCAAGGTGGAAATCAAG]

[Spacer (SEQ ID NO: 362)] [PM1 PM08 2001 (SEQ ID NO: 1494)] Amino Acid Sequence:

(SEQ ID NO: 1495)
[QGQSGQG][WTYENCWASCQPHLEGGGSSGGSISSGLLSGRSDNHGGSE

IVLTQSPATLSLSPGERATLSCRASKGVSTSGYSYLHWYQQKPGQAPRLL

IYLASYLESGVPARFSGSGSGTDFTLTISSLEPEDFAVYYCQHSRDLPLT

FGGGTKVEIK]

PM1 PM08 2001 Amino Acid Sequence:

(SEQ ID NO: 1494)
WTYENCWASCQPHLEGGGSSGGSISSGLLSGRSDNHGGSEIVLTQSPATL

SLSPGERATLSCRASKGVSTSGYSYLHWYQQKPGQAPRLLIYLASYLESG

VPARFSGSGSGTDFTLTISSLEPEDFAVYYCQHSRDLPLTFGGGTKVEIK

[Spacer (SEQ ID NO: 918)] [PM1 PM08 2001 (SEQ ID NO: 1496)] Nucleotide Sequence:

(SEQ ID NO: 1497)
[CAAGGCCAGTCTGGCCAAGGT][TGGACTTATGAGAATTGCTGGGCTTC

GTGCCAGCCTCATTTGGAGGGAGGTGGCTCGAGCGGCGGCTCTATCTCTT

CCGGACTGCTGTCCGGCAGATCCGACAATCACGGCGGATCCGAGATCGTG

CTGACACAGAGCCCTGCCACCCTGTCTCTGAGCCCTGGCGAAAGAGCCAC

CCTGAGCTGTAGAGCCTCTAAGGGCGTGTCCACCAGCGGCTACAGCTACC

TGCACTGGTATCAGCAGAAGCCCGGCCAGGCCCCCAGACTGCTGATCTAC

CTGGCCTCCTACCTGGAAAGCGGCGTGCCCGCCAGATTTTCTGGCTCTGG

CAGCGGCACCGACTTCACCCTGACAATCAGCAGCCTGGAACCCGAGGACT

TCGCCGTGTACTACTGCCAGCACAGCAGGGACCTGCCCCTGACATTTGGC

GGAGGCACCAAGGTGGAAATCAAG]

[Spacer (SEQ ID NO: 913)] [PM1 PM09 2001 (SEQ ID NO: 1498)] Amino Acid Sequence:

(SEQ ID NO: 1499)
[QGQSGQ][KLTEDFSSAAGSSGGSISSGLLSGRSDNHGGSEIVLTQSPA

TLSLSPGERATLSCRASKGVSTSGYSYLHWYQQKPGQAPRLLIYLASYLE

SGVPARFSGSGSGTDFTLTISSLEPEDFAVYYCQHSRDLPLTFGGGTKVE

IK]

PM1 PM09 2001 Amino Acid Sequence:

(SEQ ID NO: 1498)
KLTEDFSSAAGSSGGSISSGLLSGRSDNHGGSEIVLTQSPATLSLSPGER

ATLSCRASKGVSTSGYSYLHWYQQKPGQAPRLLIYLASYLESGVPARFSG

SGSGTDFTLTISSLEPEDFAVYYCQHSRDLPLTFGGGTKVEIK

[Spacer (SEQ ID NO: 1518)] [PM1 PM09 2001 (SEQ ID NO: 1500)] Nucleotide Sequence:

(SEQ ID NO: 1501)
[CAAGGCCAGTCTGGCCAA][AAGCTTACTGAGGATTTTTCTAGCGCAGC

AGGCTCGAGCGGCGGCTCTATCTCTTCCGGACTGCTGTCCGGCAGATCCG

ACAATCACGGCGGATCCGAGATCGTGCTGACACAGAGCCCTGCCACCCTG

TCTCTGAGCCCTGGCGAAAGAGCCACCCTGAGCTGTAGAGCCTCTAAGGG

CGTGTCCACCAGCGGCTACAGCTACCTGCACTGGTATCAGCAGAAGCCCG

GCCAGGCCCCCAGACTGCTGATCTACCTGGCCTCCTACCTGGAAAGCGGC

GTGCCCGCCAGATTTTCTGGCTCTGGCAGCGGCACCGACTTCACCCTGAC

AATCAGCAGCCTGGAACCCGAGGACTTCGCCGTGTACTACTGCCAGCACA

GCAGGGACCTGCCCCTGACATTTGGCGGAGGCACCAAGGTGGAAATC

AAG]

[Spacer (SEQ ID NO: 362)] [PM1 PM10 2001 (SEQ ID NO: 1502)] Amino Acid Sequence:

(SEQ ID NO: 1503)
[QGQSGQG][VGQSCFSGLVCDRQLGGGSSGGSISSGLLSGRSDNHGGSE
IVLTQSPATLSLSPGERATLSCRASKGVSTSGYSYLHWYQQKPGQAPRLL
IYLASYLESGVPARFSGSGSGTDFTLTISSLEPEDFAVYYCQHSRDLPLT
FGGGTKVEIK]

PM1 PM10 2001 Amino Acid Sequence:

(SEQ ID NO: 1502)
VGQSCFSGLVCDRQLGGGSSGGSISSGLLSGRSDNHGGSEIVLTQSPATL
SLSPGERATLSCRASKGVSTSGYSYLHWYQQKPGQAPRLLIYLASYLESG
VPARFSGSGSGTDFTLTISSLEPEDFAVYYCQHSRDLPLTFGGGTKVEIK

[Spacer (SEQ ID NO: 918)] [PM1 PM10 2001 (SEQ ID NO: 1504)] Nucleotide Sequence:

(SEQ ID NO: 1505)
[CAAGGCCAGTCTGGCCAAGGT][GTGGGGCAGAGTTGCTTTTCTGGGCT
GGTTTGCGATAGGCAGCTGGGAGGTGGCTCGAGCGGCGGCTCTATCTCTT
CCGGACTGCTGTCCGGCAGATCCGACAATCACGGCGGATCCGAGATCGTG
CTGACACAGAGCCCTGCCACCCTGTCTCTGAGCCCTGGCGAAAGAGCCAC
CCTGAGCTGTAGAGCCTCTAAGGGCGTGTCCACCAGCGGCTACAGCTACC
TGCACTGGTATCAGCAGAAGCCCGGCCAGGCCCCCAGACTGCTGATCTAC
CTGGCCTCCTACCTGGAAAGCGGCGTGCCCGCCAGATTTTCTGGCTCTGG
CAGCGGCACCGACTTCACCCTGACAATCAGCAGCCTGGAACCCGAGGACT
TCGCCGTGTACTACTGCCAGCACAGCAGGGACCTGCCCCTGACATTTGGC
GGAGGCACCAAGGTGGAAATCAAG]

[Spacer (SEQ ID NO: 913)] [PM1 PM11 2001 (SEQ ID NO: 1506)] Amino Acid Sequence:

(SEQ ID NO: 1507)
[QGQSGQ][ISHYCFSGKSCRDGSSGGSISSGLLSGRSDNHGGSEIVLTQ
SPATLSLSPGERATLSCRASKGVSTSGYSYLHWYQQKPGQAPRLLIYLAS
YLESGVPARFSGSGSGTDFTLTISSLEPEDFAVYYCQHSRDLPLTFGGGT
KVEIK]

PM1 PM11 2001 Amino Acid Sequence:

(SEQ ID NO: 1506)
ISHYCFSGKSCRDGSSGGSISSGLLSGRSDNHGGSEIVLTQSPATLSLSP
GERATLSCRASKGVSTSGYSYLHWYQQKPGQAPRLLIYLASYLESGVPAR
FSGSGSGTDFTLTISSLEPEDFAVYYCQHSRDLPLTFGGGTKVEIK

[Spacer (SEQ ID NO: 1518)] [PM1 PM11 2001 (SEQ ID NO: 1508)] Nucleotide Sequence:

(SEQ ID NO: 1509)
[CAAGGCCAGTCTGGCCAA][ATCTCTCACTATTGTTTCAGTGGCAAATC
CTGCAGGGACGGCTCGAGCGGCGGCTCTATCTCTTCCGGACTGCTGTCCG
GCAGATCCGACAATCACGGCGGATCCGAGATCGTGCTGACACAGAGCCCT
GCCACCCTGTCTCTGAGCCCTGGCGAAAGAGCCACCCTGAGCTGTAGAGC
CTCTAAGGGCGTGTCCACCAGCGGCTACAGCTACCTGCACTGGTATCAGC
AGAAGCCCGGCCAGGCCCCCAGACTGCTGATCTACCTGGCCTCCTACCTG
GAAAGCGGCGTGCCCGCCAGATTTTCTGGCTCTGGCAGCGGCACCGACTT
CACCCTGACAATCAGCAGCCTGGAACCCGAGGACTTCGCCGTGTACTACT
GCCAGCACAGCAGGGACCTGCCCCTGACATTTGGCGGAGGCACCAAGGTG
GAAATCAAG]

[Spacer (SEQ ID NO: 362)] [PM1 PM12 2001 (SEQ ID NO: 1510)] Amino Acid Sequence:

(SEQ ID NO: 1511)
[QGQSGQG][HCIPDFTSAAGDCMRGGGSSGGSISSGLLSGRSDNHGGSE
IVLTQSPATLSLSPGERATLSCRASKGVSTSGYSYLHWYQQKPGQAPRLL
IYLASYLESGVPARFSGSGSGTDFTLTISSLEPEDFAVYYCQHSRDLPLT
FGGGTKVEIK]

PM1 PM12 2001 Amino Acid Sequence:

(SEQ ID NO: 1510)
HCIPDFTSAAGDCMRGGGSSGGSISSGLLSGRSDNHGGSEIVLTQSPATL
SLSPGERATLSCRASKGVSTSGYSYLHWYQQKPGQAPRLLIYLASYLESG
VPARFSGSGSGTDFTLTISSLEPEDFAVYYCQHSRDLPLTFGGGTKVEIK

[Spacer (SEQ ID NO: 918)] [PM1 PM12 2001 (SEQ ID NO: 1512)] Nucleotide Sequence:

(SEQ ID NO: 1513)
[CAAGGCCAGTCTGGCCAAGGT][CATTGCATTCCTGATTTTACTTCTGC
TGCTGGTGATTGCATGAGGGGAGGTGGCTCGAGCGGCGGCTCTATCTCTT
CCGGACTGCTGTCCGGCAGATCCGACAATCACGGCGGATCCGAGATCGTG
CTGACACAGAGCCCTGCCACCCTGTCTCTGAGCCCTGGCGAAAGAGCCAC
CCTGAGCTGTAGAGCCTCTAAGGGCGTGTCCACCAGCGGCTACAGCTACC
TGCACTGGTATCAGCAGAAGCCCGGCCAGGCCCCCAGACTGCTGATCTAC
CTGGCCTCCTACCTGGAAAGCGGCGTGCCCGCCAGATTTTCTGGCTCTGG
CAGCGGCACCGACTTCACCCTGACAATCAGCAGCCTGGAACCCGAGGACT
TCGCCGTGTACTACTGCCAGCACAGCAGGGACCTGCCCCTGACATTTGGC
GGAGGCACCAAGGTGGAAATCAAG]

PM1 HC Variable (SEQ ID NO: 1514)
QVQLVQSGVEVKKPGASVKVSCKAS<u>GYTFTNYY</u>MYWVRQAPGQGLEWMGG
<u>INPSNGGT</u>NFNEKFKNRVTLTTDSSTTTAYMELKSLQFDDTAVYYCA<u>RRD
YRFDMGFDY</u>WGQGTTVTVSS PM1 HC Variable (SEQ ID NO: 1515)
CAGGTGCAGCTGGTGCAGTCTGGCGTGGAAGTGAAGAAACCAGGCGCCAG

CGTGAAGGTGTCCTGCAAGGCCAGCGGCTACACCTTTACCAACTACTACA

TGTACTGGGTGCGCCAGGCCCCAGGCCAGGGACTGGAATGGATGGCGGC

ATCAACCCCAGCAACGGCGGCACCAACTTCAACGAGAAGTTCAAGAACAG

AGTGACCCTGACCACCGACAGCAGCACCACCACCGCCTACATGGAACTGA

AGTCCCTGCAGTTCGACGACACCGCCGTGTACTACTGCGCCAGACGGGAC

TACAGATTCGACATGGGCTTCGACTACTGGGGCCAGGGCACAACCGTGAC

CGTGTCTAGT

Example 24: Characterization of Activatable Anti-PD1 PM1 Antibodies

This example describes activatable anti-PD1 PM1 antibodies with reduced binding to hPD1.

Figure 27A:
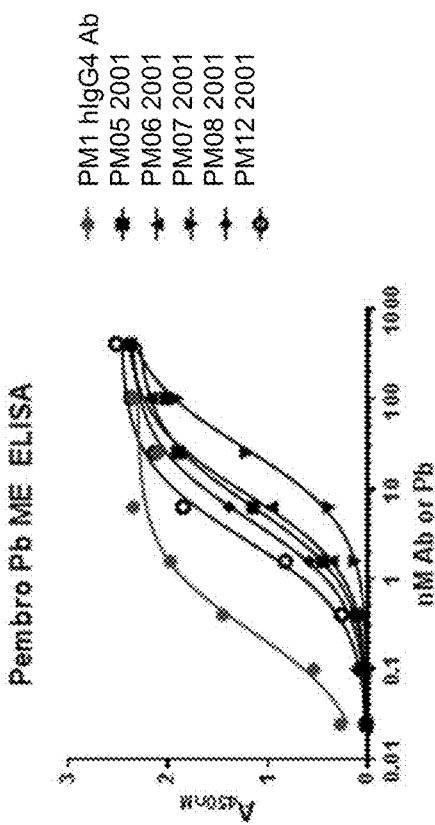
FIGS. 27A, 27B, and 27C are a series of graphs depicting the binding to hPD-1 by the anti-PD-1 antibody pembrolizumab (PM1) and by various activatable antibodies of the disclosure comprising the anti-PD1 antibody PM1, the substrate referred to herein as 2001 (SEQ ID NO: 214), and the masking moieties referred to herein PM01 (SEQ ID NO: 1351), PM02 (SEQ ID NO: 1352), PM03 (SEQ ID NO: 1353), PM04 (SEQ ID NO: 1354), PM05 (SEQ ID NO: 1355), PM06 (SEQ ID NO: 1356), PM07 (SEQ ID NO: 1357), PM08 (SEQ ID NO: 1358), PM09 (SEQ ID NO: 1359), PM10 (SEQ ID NO: 1360), PM11 (SEQ ID NO: 1361), and PM12 (SEQ ID NO: 1362).
Figure 27B:
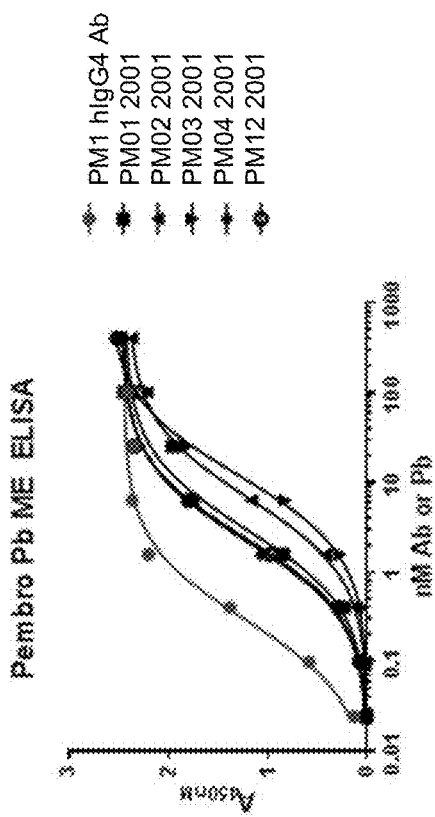
Figure 27C:
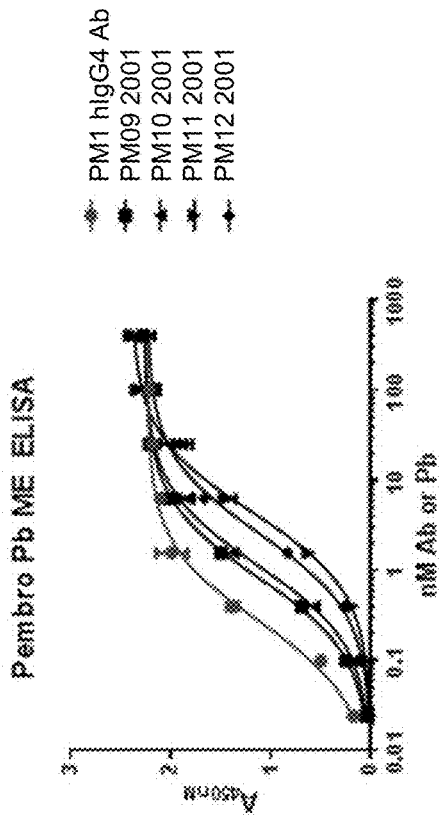

Masking efficiencies were evaluated by standard plate ELISA. Briefly, human PD1-Fc (R and D systems, Minneapolis, Minn.) was adsorbed to the wells of a 96-well ELISA plate. Purified PM1 and activatable PM1 antibodies were applied to the plate in serial dilution and allowed to bind. Bound antibody and activatable antibodies were detected with anti-hu Fab-HRP conjugate (Sigma, St Louis, Mo.) and visualized with the chromogenic substrate TMB (Thermo Scientific, Rockford, Ill.). Plots were generated in Prizm (Sigma Plot). All activatable PM1 antibodies showed decreased binding compared with the parental PM1, as shown in FIGS. 27A, 27B, and 27C.

Figure 28:
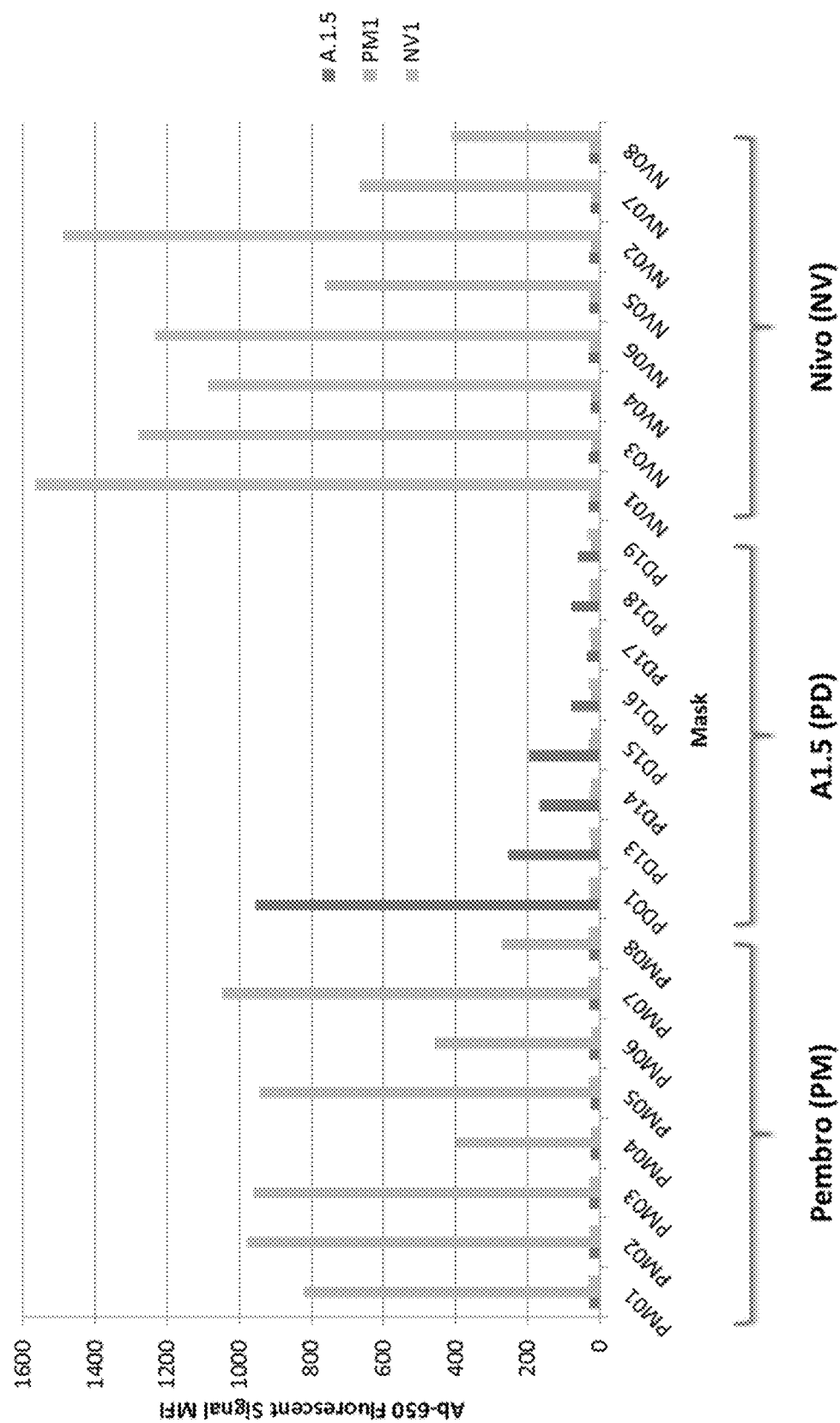
FIG. 28 is a graph depicting the masking moiety specificity for various activatable antibodies of the disclosure that comprise the anti-PD-1 A1.5 (PD) antibody, the NV1 (NV) antibody, and the PM1 (PM) antibody and a variety of mask and substrate combinations.

Example 25: Characterization of Anti-PD1 Activatable Antibodies of the Disclosure The binding properties of several masking moieties of the disclosure identified for A1.5 (PD), NV1 (NV) and PM1 (PM) antibodies were evaluated. Eight peptide clones from each mask discovery effort were grown overnight at 37° C., 850 rpm in 2 mL deep well plates in LB+Chloramphenicol+ 0.2% glucose, diluted 1:20 in LB+Chloramphenicol and grown 105 minutes at 37° C., 850 rpm. Peptide expression was induced by the addition of 0.04% arabinose for 35 minutes, and clones were stained with 1 nM A1.5-DyLight 650, 1 nM PM1-Dylight 650 and 1 nM NV1-Dylight 650 in cold PBS+0.5% BSA. Clones were pelleted, the staining solution was removed, and cells were resuspended in PBS+ 1% formaldehyde. Fluorescence was measured on a MACSQuant Analyzer 10 flow cytometer manufactured by Miltenyi Biotec, Inc. (San Diego, Calif.). As shown in FIG. 28, masking moieties bound to the anti-PD1 antibody used in the library screening from which they were identified.

Example 26: Evaluation of Masking Moiety Binding by Effector Negative Activatable Antibodies This example describes additional activatable anti-PD-1 J43 antibodies that exhibit reduced binding to mouse PD-1.

Examples of additional activatable antibodies of the disclosure comprising an IgG2a effector negative (EN) anti-PD1 antibody J43 (J43 m2a EN) and a variety of mask and substrate combinations were produced using techniques as described herein. The amino acid and nucleic acid sequences of the constant region of the IgG2a EN antibody are provided below. A plasmid encoding this effector negative Fc region, pFUSE-mIgG2Ae1-Fc, is available from InvivoGen, San Diego, Calif. The Fc region of mIgG2a was engineered by mutating the following amino acids to reduce binding to FcR and C1q: L235E and E318A/K320A/K322A.

>mIgG2a EN (SEQ ID NO: 1516)
AKTTAPSVYPLAPVCGDTTGSSVTLGCLVKGYFPEPVTLTWNSGSLSSGV

HTFPAVLQSDLYTLSSSVTVTSSTWPSQSITCNVAHPASSTKVDKKIEPR

GPTIKPCPPCKCPAPNLEGGPSVFIFPPKIKDVLMISLSPIVTCVVVDVS

EDDPDVQISWFVNNVEVHTAQTQTHREDYNSTLRVVSALPIQHQDWMSGK

AFACAVNNKDLPAPIERTISKPKGSVRAPQVYVLPPPEEEMTKKQVTLTC

MVTDFMPEDIYVEWTNNGKTELNYKNTEPVLDSDGSYFMYSKLRVEKKNW

VERNSYSCSVVHEGLHNHHTTKSFSRTPGK

>mIgG2a EN (SEQ ID NO: 1517)
GCCAAGACAACAGCCCCCAGCGTGTACCCTCTGGCCCCTGTGTGTGGCGA

TACCACAGGCAGCTCTGTGACCCTGGGCTGCCTCGTGAAGGGCTACTTCC

CTGAGCCAGTGACCCTGACCTGGAACAGCGGCTCTCTGTCTAGCGGCGTG

CACACCTTTCCAGCCGTGCTGCAGAGCGACCTGTACACCCTGAGCAGCAG

CGTGACCGTGACCAGCAGCACATGGCCCAGCCAGAGCATCACCTGTAACG

TGGCCCACCCTGCCAGCTCCACCAAGGTGGACAAGAAGATCGAGCCCAGA

GGCCCCACCATCAAGCCTTGCCCCCCTTGCAAATGCCCTGCCCCCAATCT

GGAAGGCGGCCCTAGCGTGTTCATCTTCCCACCCAAGATCAAGGACGTGC

TGATGATCAGCCTGAGCCCCATCGTGACCTGCGTGGTGGTGGACGTGTCC

GAGGACGACCCCGATGTGCAGATCAGTTGGTTCGTGAACAACGTGGAAGT

GCACACCGCCCAGACCCAGACACACAGAGGAGGACTACAACAGCACCCTGA

GAGTGGTGTCCGCCCTGCCCATCCAGCACCAGGATTGGATGAGCGGCAAG

GCCTTCGCCTGCGCTGTGAACAACAAGGACCTGCCAGCCCCCATCGAGCG

GACCATCTCTAAGCCTAAGGGCAGCGTGCGGGCTCCCCAGGTGTACGTGC

TGCCTCCTCCAGAGGAAGAGATGACCAAGAAACAAGTGACACTGACATGC

ATGGTCACCGACTTCATGCCCGAGGACATCTACGTGGAATGGACCAACAA

CGGCAAGACCGAGCTGAACTACAAGAACACCGAGCCCGTGCTGGACAGCG

ACGGCAGCTACTTCATGTACAGCAAGCTGCGGGTGGAAAAGAAAAACTGG

GTGGAACGAACAGCTACAGCTGCAGCGTGGTGCACGAGGGCCTGCACAA

TCACCACACCACCAAGAGCTTCAGCCGGACCCCTGGAAAA

Figure 29A:
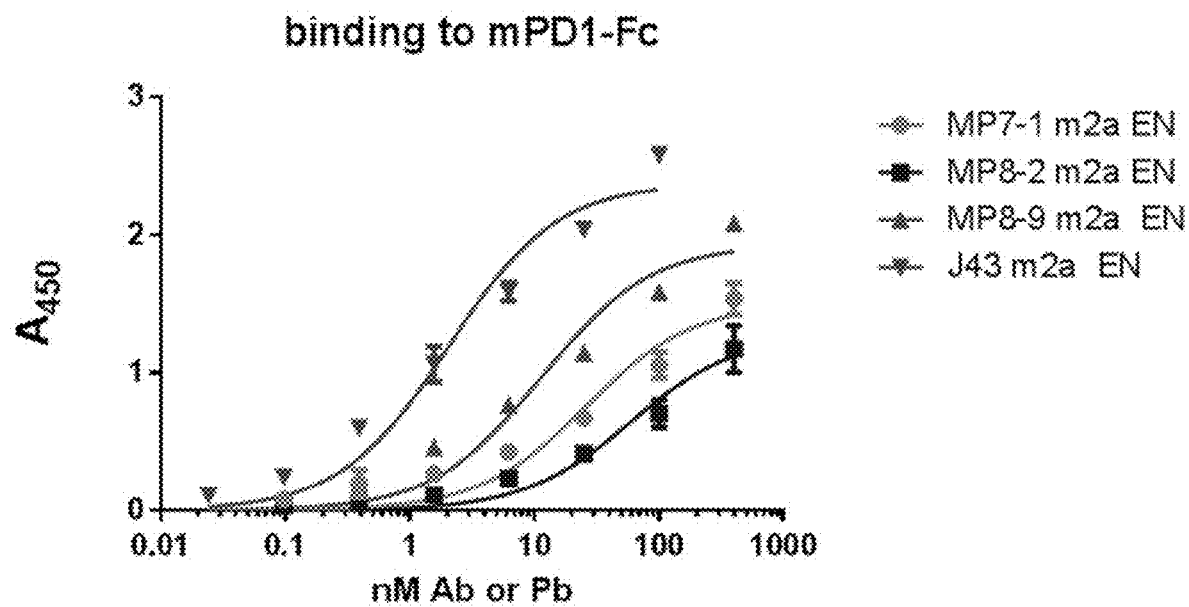
FIGS. 29A and 29B are a series of graphs depicting the binding to PD1 by the IgG2a effector negative (EN) anti-PD1 antibody J43 (J43 m2a EN) and by various activatable antibodies of the disclosure comprising the IgG2a effector negative (EN) anti-PD1 antibody J43 (J43 m2a EN) and a variety of mask and substrate combinations.
Figure 29B:
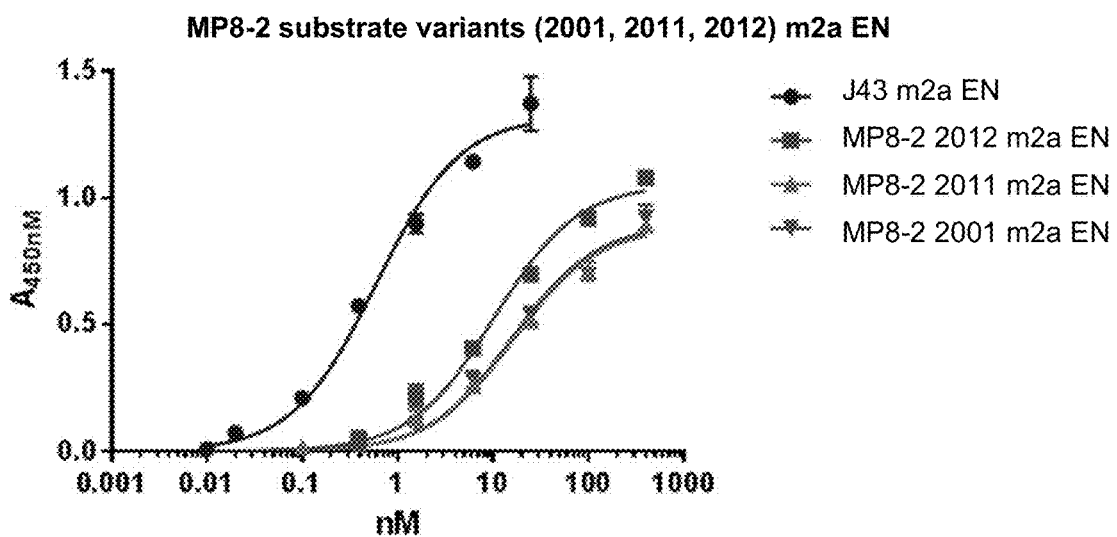

Masking efficiencies of several of these activatable antibodies were determined as described herein. The results are shown in FIG. 29A and FIG. 29B.

J43m2a EN Activatable Antibody LCs:
[Spacer (SEQ ID NO: 362)] [J43m2a EN MP8-2 2001 (SEQ ID NO: 1808)] Amino Acid Sequence:

(SEQ ID NO: 1809)
[QGQSGQG][ACRICQDHPATKWNSGGGSSGGSISSGLLSGRSDNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2001 Amino Acid Sequence:

(SEQ ID NO: 1808)
ACRICQDHPATKWNSGGGSSGGSISSGLLSGRSDNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

[Spacer (SEQ ID NO: 362)] [J43m2a EN MP8-2 2011 (SEQ ID NO: 1810)] Amino Acid Sequence:

(SEQ ID NO: 1811)
[QGQSGQG][ACRICQDHPATKWNSGGGSSGGSISSGLLSGRSDNPGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2011 Amino Acid Sequence:

(SEQ ID NO: 1810)
ACRICQDHPATKWNSGGGSSGGSISSGLLSGRSDNPGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

[Spacer (SEQ ID NO: 362)] [J43m2a EN MP8-2 2012 (SEQ ID NO: 1812)] Amino Acid Sequence:

(SEQ ID NO: 1813)
[QGQSGQG][ACRICQDHPATKWNSGGGSSGGSISSGLLSGRSANPGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2012 Amino Acid Sequence:

(SEQ ID NO: 1812)
ACRICQDHPATKWNSGGGSSGGSISSGLLSGRSANPGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

[Spacer (SEQ ID NO: 362)] [J43m2a EN MP8-2 2002 (SEQ ID NO: 1814)] Amino Acid Sequence:

(SEQ ID NO: 1815)
[QGQSGQG][ACRICQDHPATKWNSGGGSSGGSISSGLLSGRSGNHGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2002 Amino Acid Sequence:

(SEQ ID NO: 1814)
ACRICQDHPATKWNSGGGSSGGSISSGLLSGRSGNHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

[Spacer (SEQ ID NO: 362)] [J43m2a EN MP8-2 2003 (SEQ ID NO: 1816)] Amino Acid Sequence:

(SEQ ID NO: 1817)
[QGQSGQG][ACRICQDHPATKWNSGGGSSGGSISSGLLSGRSANPRGGG
GSYELTQPPSASVNVGETVKITCSGDQLPKYFADWFHQRSDQTILQVIYD
DNKRPSGIPERISGSSSGTTATLTIRDVRAEDEGDYYCFSGYVDSDSKLY
VFGSGTQLTVLGGPKSSPKVTVFPPSPEELRTNKATLVCLVNDFYPGSAT
VTWKANGATINDGVKTTKPSKQGQNYMTSSYLSLTADQWKSHNRVSCQVT
HEGETVEKSLSPAECL]

J43m2a EN MP8-2 2003 Amino Acid Sequence:

(SEQ ID NO: 1816)
ACRICQDHPATKWNSGGGSSGGSISSGLLSGRSANPRGGGGSYELTQPPS
ASVNVGETVKITCSGDQLPKYFADWFHQRSDQTILQVIYDDNKRPSGIPE

```
RISGSSSGTTATLTIRDVRAEDEGDYYCFSGYVDSDSKLYVFGSGTQLTV

LGGPKSSPKVTVFPPSPEELRTNKATLVCLVNDFYPGSATVTWKANGATI

NDGVKTTKPSKQGQNYMTSSYLSLTADQWKSHNRVSCQVTHEGETVEKSL

SPAECL
```

[Spacer (SEQ ID NO: 362)] [J43m2a EN MP8-2 2006 (SEQ ID NO: 1818)] Amino Acid Sequence:

```
                                      (SEQ ID NO: 1819)
[QGQSGQG][ACRICQDHPATKWNSGGGSSGGSISSGLLSGRSDDHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVLGGPKSSPKVTVFPPSPEELRTNKATLVCLVNDFYPGSATVT

WKANGATINDGVKTTKPSKQGQNYMTSSYLSLTADQWKSHNRVSCQVTHE

GETVEKSLSPAECL]
```

J43m2a EN MP8-2 2006 Amino Acid Sequence:

```
                                      (SEQ ID NO: 1818)
ACRICQDHPATKWNSGGGSSGGSISSGLLSGRSDDHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVLG

GPKSSPKVTVFPPSPEELRTNKATLVCLVNDFYPGSATVTWKANGATIND

GVKTTKPSKQGQNYMTSSYLSLTADQWKSHNRVSCQVTHEGETVEKSLSP

AECL
```

[Spacer (SEQ ID NO: 362)] [J43m2a EN MP8-2 2007 (SEQ ID NO: 1820)] Amino Acid Sequence:

```
                                      (SEQ ID NO: 1821)
[QGQSGQG][ACRICQDHPATKWNSGGGSSGGSISSGLLSGRSDIHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVLGGPKSSPKVTVFPPSPEELRTNKATLVCLVNDFYPGSATVT

WKANGATINDGVKTTKPSKQGQNYMTSSYLSLTADQWKSHNRVSCQVTHE

GETVEKSLSPAECL]
```

J43m2a EN MP8-2 2007 Amino Acid Sequence:

```
                                      (SEQ ID NO: 1820)
ACRICQDHPATKWNSGGGSSGGSISSGLLSGRSDIHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVLG

GPKSSPKVTVFPPSPEELRTNKATLVCLVNDFYPGSATVTWKANGATIND

GVKTTKPSKQGQNYMTSSYLSLTADQWKSHNRVSCQVTHEGETVEKSLSP

AECL
```

[Spacer (SEQ ID NO: 362)] [J43m2a EN MP8-2 2008 (SEQ ID NO: 1822)] Amino Acid Sequence:

```
                                      (SEQ ID NO: 1823)
[QGQSGQG][ACRICQDHPATKWNSGGGSSGGSISSGLLSGRSDQHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVLGGPKSSPKVTVFPPSPEELRTNKATLVCLVNDFYPGSATVT

WKANGATINDGVKTTKPSKQGQNYMTSSYLSLTADQWKSHNRVSCQVTHE

GETVEKSLSPAECL]
```

J43m2a EN MP8-2 2008 Amino Acid Sequence:

```
                                      (SEQ ID NO: 1822)
ACRICQDHPATKWNSGGGSSGGSISSGLLSGRSDQHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVLG

GPKSSPKVTVFPPSPEELRTNKATLVCLVNDFYPGSATVTWKANGATIND

GVKTTKPSKQGQNYMTSSYLSLTADQWKSHNRVSCQVTHEGETVEKSLSP

AECL
```

[Spacer (SEQ ID NO: 362)] [J43m2a EN MP8-2 2009 (SEQ ID NO: 1824)] Amino Acid Sequence:

```
                                      (SEQ ID NO: 1825)
[QGQSGQG][ACRICQDHPATKWNSGGGSSGGSISSGLLSGRSDTHGGGS

YELTQPPSASVNVGETVKITCSGDQLPKYFADWFHQRSDQTILQVIYDDN

KRPSGIPERISGSSSGTTATLTIRDVRAEDEGDYYCFSGYVDSDSKLYVF

GSGTQLTVLGGPKSSPKVTVFPPSPEELRTNKATLVCLVNDFYPGSATVT

WKANGATINDGVKTTKPSKQGQNYMTSSYLSLTADQWKSHNRVSCQVTHE

GETVEKSLSPAECL]
```

J43m2a EN MP8-2 2009 Amino Acid Sequence:

```
                                      (SEQ ID NO: 1824)
ACRICQDHPATKWNSGGGSSGGSISSGLLSGRSDTHGGGSYELTQPPSAS

VNVGETVKITCSGDQLPKYFADWFHQRSDQTILQVIYDDNKRPSGIPERI

SGSSSGTTATLTIRDVRAEDEGDYYCFSGYVDSDSKLYVFGSGTQLTVLG

GPKSSPKVTVFPPSPEELRTNKATLVCLVNDFYPGSATVTWKANGATIND

GVKTTKPSKQGQNYMTSSYLSLTADQWKSHNRVSCQVTHEGETVEKSLSP

AECL
```

[Spacer (SEQ ID NO: 362)] [J43m2a EN MP8-2 2010 (SEQ ID NO: 1826)] Amino Acid Sequence:

```
                                      (SEQ ID NO: 1827)
[QGQSGQG][ACRICQDHPATKWNSGGGSSGGSISSGLLSGRSDYHGGGS

YELTQPPSASVNVGETVKITCSGDQLPKYFADWFHQRSDQTILQVIYDDN
```

KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2010 Amino Acid Sequence:

(SEQ ID NO: 1826)
ACRICQDHPATKWNSGGGSSGGSISSGLLSGRSDYHGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

[Spacer (SEQ ID NO: 362)] [J43m2a EN MP8-2 2013 (SEQ ID NO: 1828)] Amino Acid Sequence:

(SEQ ID NO: 1829)
[QGQSGQG][ACRICQDHPATKWNSGGGSSGGSISSGLLSGRSANIGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2013 Amino Acid Sequence:

(SEQ ID NO: 1828)
ACRICQDHPATKWNSGGGSSGGSISSGLLSGRSANIGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

[Spacer (SEQ ID NO: 362)] [J43m2a EN MP8-2 2014 (SEQ ID NO: 1830)] Amino Acid Sequence:

(SEQ ID NO: 1831)
[QGQSGQG][ACRICQDHPATKWNSGGGSSGGSISSGLLSGRSDNIGGGS
YELTQPPSASVNVGETVKITCSGDQLPKYFADWFHQRSDQTILQVIYDDN
KRPSGIPERISGSSSGTTATLTIRDVRAEDEGDYYCFSGYVDSDSKLYVF
GSGTQLTVLGGPKSSPKVTVFPPSPEELRTNKATLVCLVNDFYPGSATVT
WKANGATINDGVKTTKPSKQGQNYMTSSYLSLTADQWKSHNRVSCQVTHE
GETVEKSLSPAECL]

J43m2a EN MP8-2 2014 Amino Acid Sequence:

(SEQ ID NO: 1830)
ACRICQDHPATKWNSGGGSSGGSISSGLLSGRSDNIGGGSYELTQPPSAS
VNVGETVKITCSGDQLPKYFADWFHQRSDQTILQVIYDDNKRPSGIPERI
SGSSSGTTATLTIRDVRAEDEGDYYCFSGYVDSDSKLYVFGSGTQLTVLG
GPKSSPKVTVFPPSPEELRTNKATLVCLVNDFYPGSATVTWKANGATIND
GVKTTKPSKQGQNYMTSSYLSLTADQWKSHNRVSCQVTHEGETVEKSLSP
AECL

Example 27: Activatable Anti-Mouse PD1 J43 m2a EN Antibodies Reduce Incidence of Diabetes in NOD Mice In this Example, anti-PD1 J43 m2a EN (effector negative) activatable antibodies were analyzed for the ability to protect from PD1 m2a EN-mediated induction of diabetes in NOD mice.

The NOD mice, substrain NOD/ShiLtJ, were obtained from Jackson Laboratory at 8 weeks and acclimated on site for 2 weeks. At 10 weeks, mice were checked for diabetes prior to enrollment, grouped, and dosed as set forth in Table 21.

| Group | Count | Gender | Treatment | Dose (mg/kg) | Dose volume (mL/kg) | Schedule | Route |
|---|---|---|---|---|---|---|---|
| 1 | 7 | F | mIgG2a (C1.18.4) | 10 | 10 | q7dx1 | IP |
| 2 | 7 | F | Anti-PD-1 J43 m2a EN | 10 | 10 | q7dx1 | IP |
| 3 | 7 | F | Anti-PD-1 J43 m2a EN | 3 | 10 | q7dx1 | IP |
| 4 | 7 | F | Anti-PD-1 J43 m2a EN | 1 | 10 | q7dx1 | IP |
| 5 | 7 | F | J43 MP7-1 2001 m2a EN | 10 | 10 | q7dx1 | IP |
| 6 | 7 | F | J43 MP7-1 2001 m2a EN | 3 | 10 | q7dx1 | IP |
| 7 | 7 | F | J43 MP8-2 2001 m2a EN | 10 | 10 | q7dx1 | IP |
| 8 | 7 | F | J43 MP8-2 2001 m2a EN | 3 | 10 | q7dx1 | IP |

Figure 30:
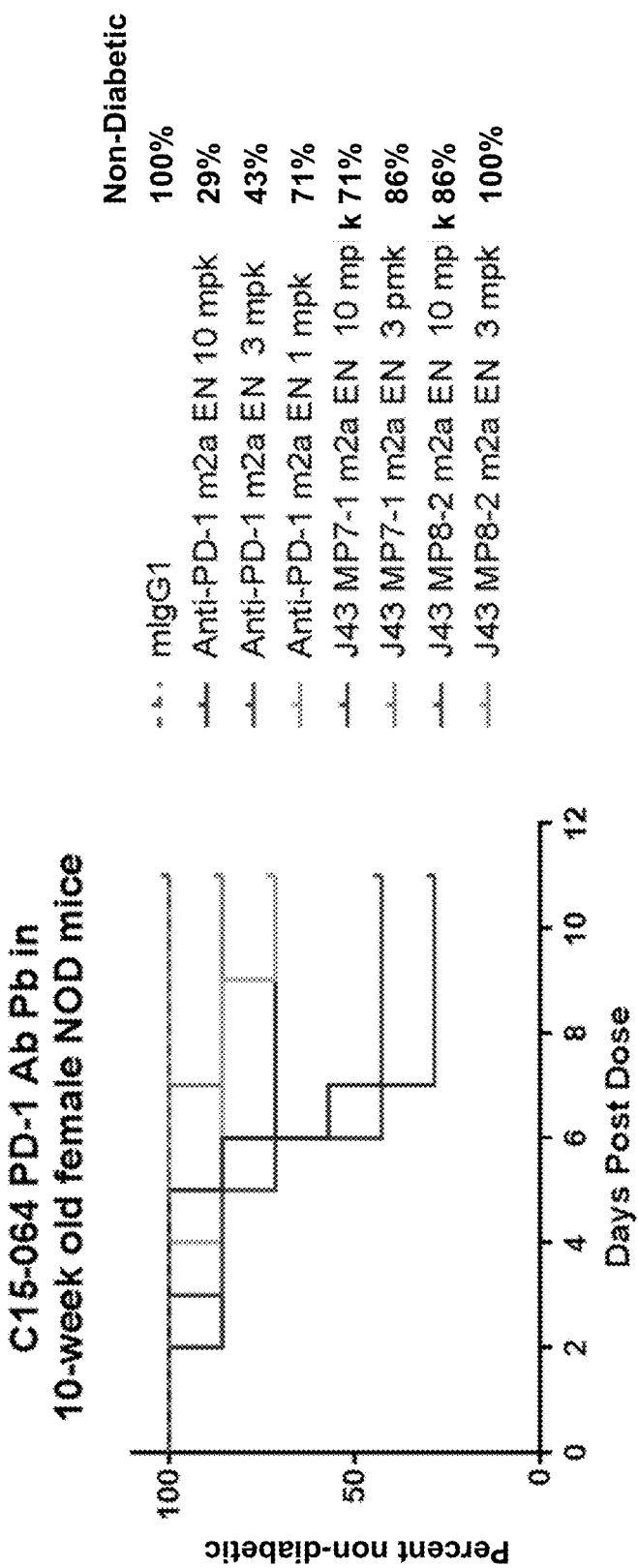
FIG. 30 is a graph depicting that the anti-PD-1 J43m2a EN antibody induced diabetes in NOD mice with increased frequency as dosage increased and that anti-PD-1 J43m2a EN activatable antibodies exhibited reduced diabetes compared to antibodies at similar doses.

FIG. 30 which plots % non-diabetic versus number of days post dose, shows that anti-PD-1 J43 antibody induced diabetes in NOD mice with increased frequency as dosage increased. At day eleven post dose, the percentage of non-diabetic mice for the antibody-treated groups was 29%, 43% and 71% for the 10 mg/kg, 3 mg/kg and 1 mg/kg dose groups, respectively. Activatable antibodies J43 MP7-1 2001 m2a EN and J43 MP8-2 2001 m2a EN required increased doses to induce diabetes at frequencies comparable to the parental antibody. At day eleven post dose with J43 MP7-1 2001 m2a EN, 71% of the 10 mg/kg group remained non-diabetic and 86% of the 3 mg/kg were non-diabetic. At day fourteen post dose with J43 MP8-2 2001 m2a EN, 86% of the 10 mg/kg group and 100% of the 3 mg/kg group remained non-diabetic.

Example 28. Activatable Anti-Mouse PD1 J43 m2a EN Antibodies Show Efficacy in the MC38 Syngeneic Tumor Model This Example demonstrates that activatable antibodies of the embodiments are able to reduce the growth of MC38 syngeneic tumors.

In this Example, anti-PD1 activatable antibodies J43 MP7-1 2001 m2a EN and J43 MP8-2 2001 m2a EN were analyzed for the ability to reduce the growth of MC38 syngeneic tumors.

The mouse colon carcinoma cell line MC38 was obtained from ATCC. MC38 were grown in RPMI-1640 supplemented with 10% fetal bovine serum at 37° C. in an atmosphere of 5% $CO_2$ in air. Cells were harvested during the logarithmic growth period, resuspended in PBS with proper cell concentration, and kept on ice for tumor induction.

Each mouse was inoculated subcutaneously at the right flank with $1.5 \times 10^6$ of MC38 cells in PBS for tumor development. The treatments were started when the mean tumor size reached approximately 80 mm$^3$ (60-120 mm$^3$). Tumor sizes were measured twice weekly in two dimensions using a caliper, and the volume was expressed in mm$^3$ using the formula: $V = 0.5 \; a \times b^2$ where a and b are the long and short diameters of the tumor, respectively.

The mice were grouped and dosed as set forth in Table 22.

TABLE 22

| Group | Count | Treatment | Dose (mg/kg) | Dose volume (mL/kg) | Schedule | Route |
|---|---|---|---|---|---|---|
| 1 | 10 | mIgG1 MOPC-21 + mIgG12b MPC-11 | 10 + 10 | 10 | b.i.w. for 3 weeks | IP |
| 2 | 10 | Anti-CTLA4 9D9 mIgG2b | 10 | 10 | b.i.w. for 3 weeks | IP |
| 3 | 10 | Anti-PD-1 (J43 m2a EN) | 10 | 10 | b.i.w. for 3 weeks | IP |
| 4 | 10 | J43 MP8-2 2001 m2a EN | 10 | 10 | b.i.w. for 3 weeks | IP |
| 5 | 10 | J43 MP7-1 2001 m2a EN | 10 | 10 | b.i.w. for 3 weeks | IP |
| 6 | 10 | Anti-PD-1 (J43 m2a EN) + Anti-CTLA4 9D9 mIgG2b | 10 + 10 | 10 | b.i.w. for 3 weeks | IP |
| 7 | 10 | J43 MP8-2 2001 m2a EN + Anti-CTLA4 9D9 mIgG2b | 10 + 10 | 10 | b.i.w. for 3 weeks | IP |
| 8 | 10 | J43 MP7-1 2001 m2a EN + Anti-CTLA4 9D9 mIgG2b | 10 + 10 | 10 | b.i.w. for 3 weeks | IP |

Figure 31A:
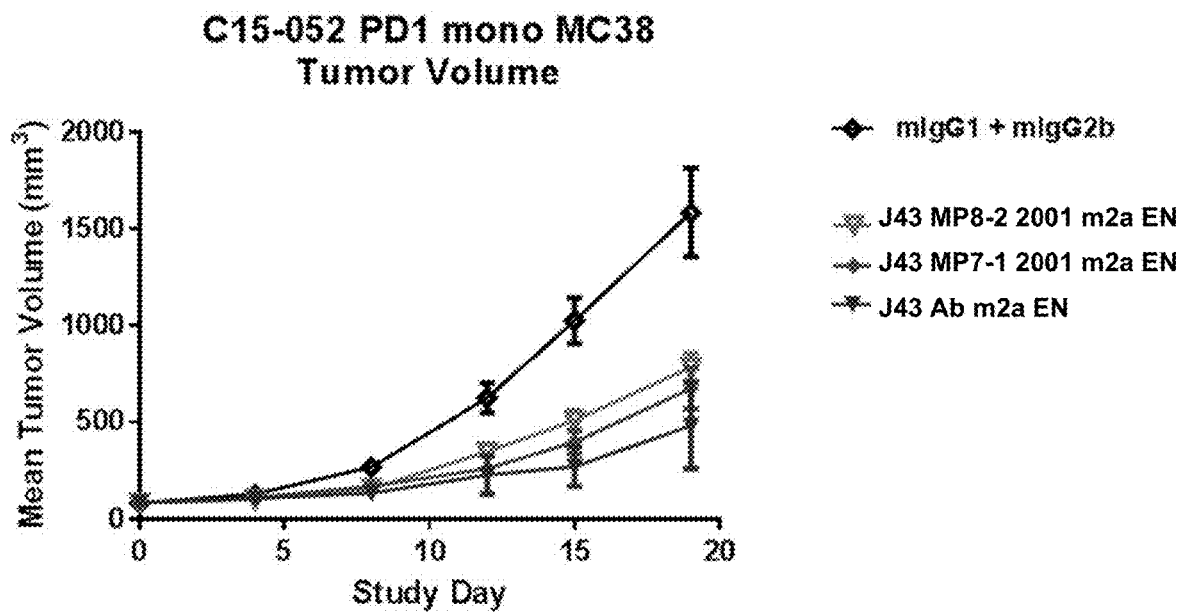
FIGS. 31A and 31B are a series of graphs depicting that anti-PD1 activatable antibodies of the disclosure MP7-1 2001 m2a EN and MP8-2 2001 m2a EN inhibit the growth of MC38 syngeneic tumors in a manner similar to positive control anti-PD1 antibody J43 m2a EN both as single agents (FIG. 31A) and in combination with the commercially available anti-CTLA4 antibody 9D9 mIgG2b (FIG. 31B).
Figure 31B:
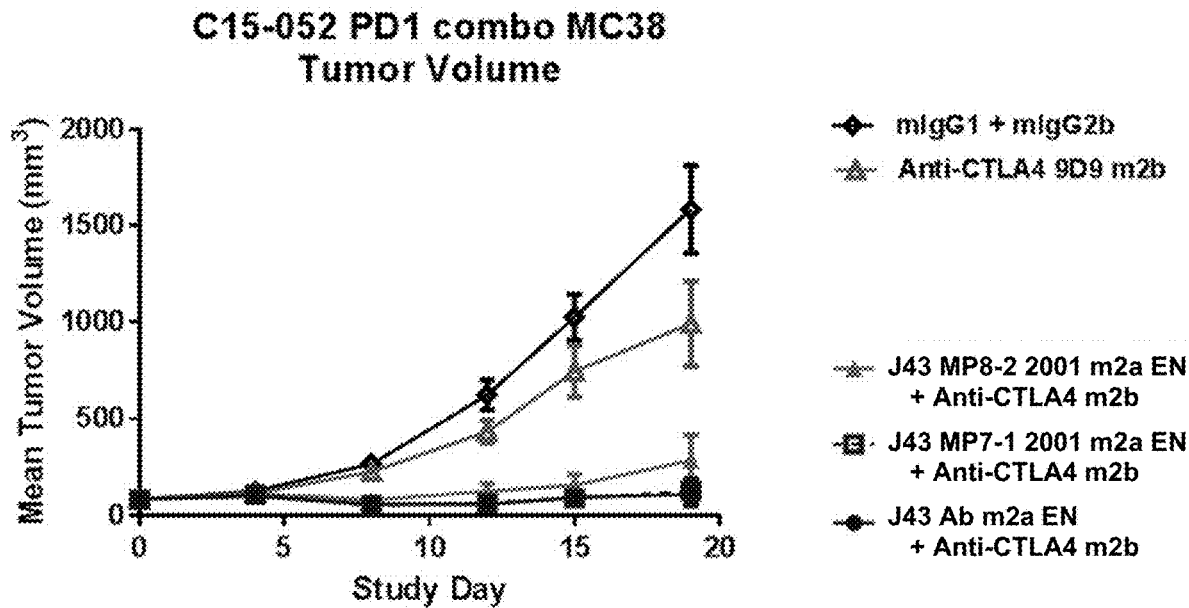

FIGS. 31A and 31B, which plots tumor volume versus number of days post initial dose, demonstrates that anti-PD1 activatable antibodies MP7-1 2001 m2a EN and MP8-2 2001 m2a EN inhibit the growth of MC38 syngeneic tumors similar to positive control anti-PD1 antibody J43 m2a EN both as single agents and in combination with anti-CTLA4 antibody 9D9 mIgG2b (BioXCell, West Lebanon, N.H.).

Example 29. Evaluation of Anti-Human PD1 Antibodies and Activatable Anti-Human PD1 Antibodies in Antigen Recall Assay This Example demonstrates that anti-PD1 antibodies and activated activatable anti-PD1 antibodies of the embodiments (i.e., activatable antibodies in which the CM has been cleaved by a protease) are able to block PD-L1/PD-L2 binding to PD1 and to activate T cells in an antigen recall assay.

Figure 32A:
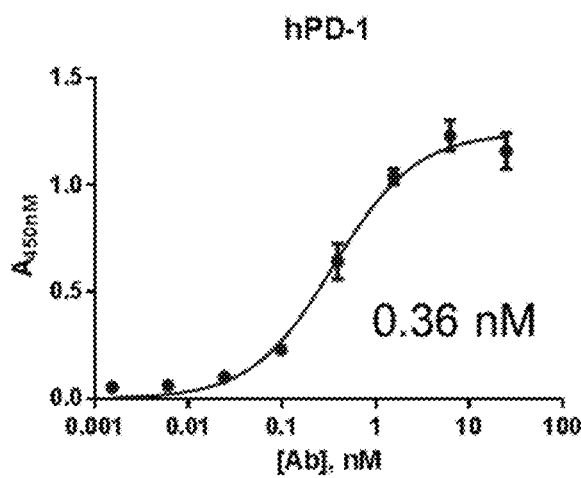
FIGS. 32A, 32B, 32C, 32D, and 32E are a series of graphs depicting that the anti-human PD1 antibody referred to herein as A1.5 Ab (i.e., VH of SEQ ID NO: 21 and VL of SEQ ID NO: 47) blocks PD-L1/PD-L2 binding to PD1 and potently activates T cells in an antigen recall assay.
Figure 32B:
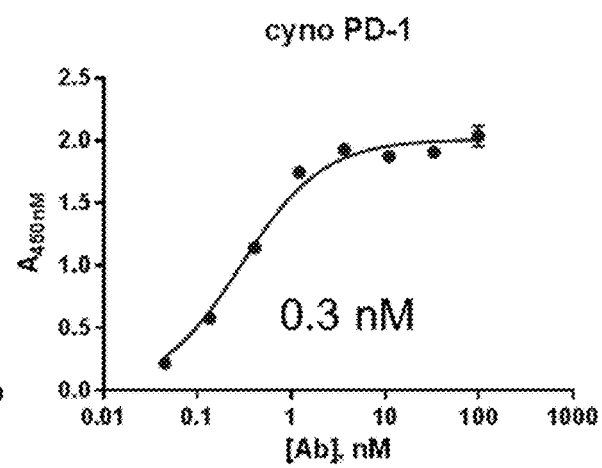
Figure 32C:
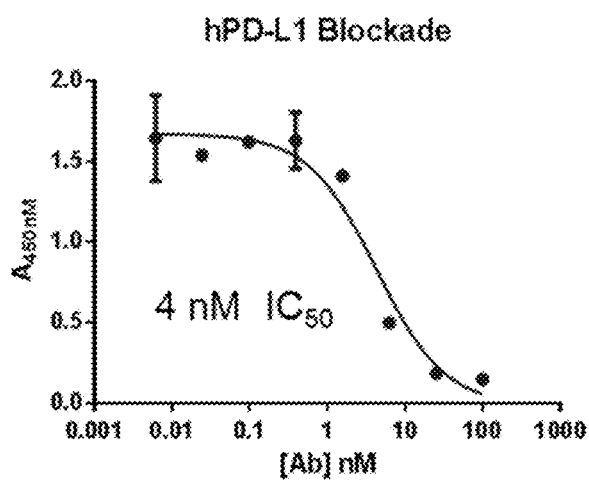
Figure 32D:
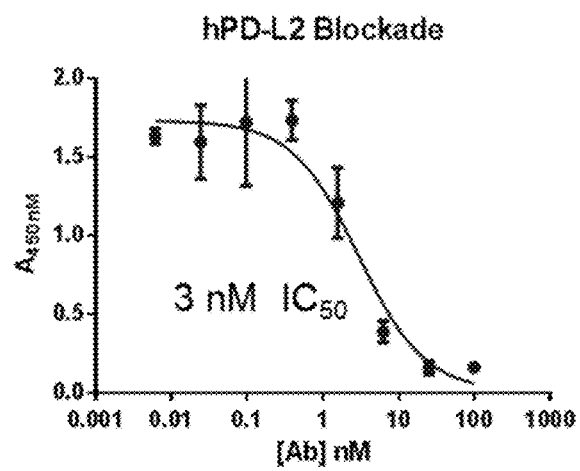

As shown in FIGS. 32A-32E, the anti-human PD1 antibody referred to herein as A1.5 Ab (i.e., VH of SEQ ID NO: 21 and VL of SEQ ID NO: 47) blocks PD-L1/PD-L2 binding to PD1 and potently activates T cells in an antigen recall assay. The binding of the anti-human PD-1 A1.5 Ab to immobilized human PD1 as detected by standard plate ELISA is shown in FIG. 32A, and the binding of A1.5 Ab to cynomolgus PD1 (also referred to herein as cyno-PD1, Sino Biological Cat. #90311-C02H) as detected by ELISA is shown in FIG. 32B. The inhibition of biotinylated human PD-L1 (also referred to herein as biotin-PD-L1) to immobilized PD1 by A1.5 Ab as determined by ELISA is shown in FIG. 32C, and the inhibition of biotinylated human PD-L2 (also referred to herein as biotin-PD-L2) to immobilized PD1 as determined by ELISA is shown in FIG. 32D.

Figure 32E:
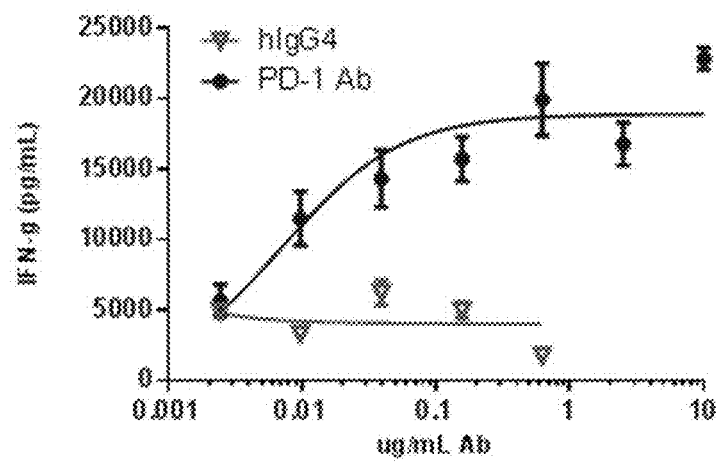

As shown in FIG. 32E, the A1.5 Ab enhances IFN-γ production in a CMV T cell restimulation assay. Briefly, CMV$^+$ human PBMCs were plated at 250,000 cells/well with isotype control antibody or with the A1.5 Ab and stimulated with 5 µg/mL CMV lysate for 4 days. Supernatant IFN-γ levels were measured by ELISA.

Figure 33A:
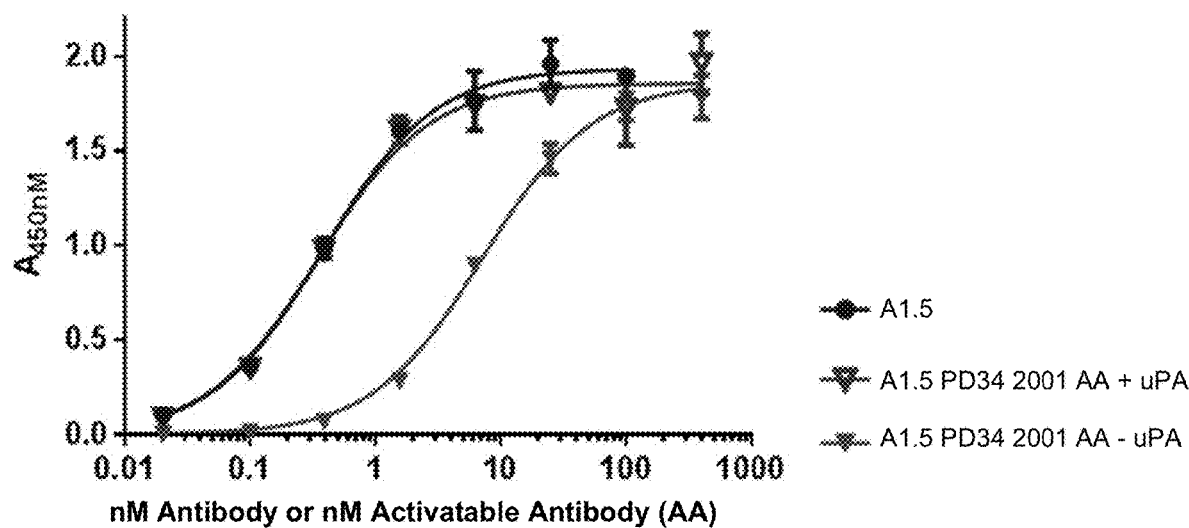
FIGS. 33A and 33B are a series of graphs depicting that the activatable anti-PD1 antibody referred to herein as A1.5 PD34 2001 (i.e., VH of SEQ ID NO: 21, VL of SEQ ID NO: 47, masking moiety of SEQ ID NO: 99, and cleavable moiety of SEQ ID NO: 214) binds human PD1 with decreased affinity relative to the parental PD-1 Ab, i.e., A1.5 Ab (FIG. 33A), and the A1.5 PD34 2001 activatable antibody shows functional masking in a CMV T cell antigen recall assay (FIG. 33B).
Figure 33B:
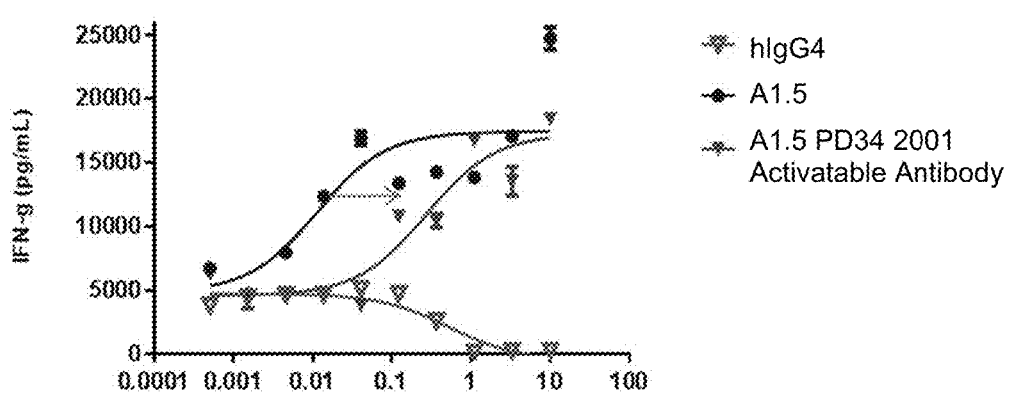

As shown in FIGS. 33A and 33B, the activatable anti-PD1 antibody referred to herein as A1.5 PD34 2001 (i.e., VH of SEQ ID NO: 21, VL of SEQ ID NO: 47, masking moiety of SEQ ID NO: 99, and cleavable moiety of SEQ ID NO: 214) binds human PD1 with decreased affinity relative to the parental PD-1 Ab, i.e., A1.5 Ab (FIG. 33A), and the A1.5 PD34 2001 activatable antibody shows functional masking in a CMV T cell antigen recall assay (FIG. 33B). Briefly, 4 mg/mL of the A1.5 PD34 2001 activatable antibody was combined with 0 µg/mL or 60 µg/mL recombinant human urokinase (rh uPA, R&D, Cat. #1310-SE) and incubated at 37° C. overnight. Binding of the activatable antibody incubated with uPA to hPD1 was assayed by standard plate ELISA. As shown in FIG. 33, the activatable anti-PD1 antibodies of the disclosure regain full binding activated after activation by a protease.

Example 30. Pharmacokinetic Evaluation of Activatable Anti-Human PD1 Antibodies in Non-Human Primate Model This Example demonstrates pharmacokinetic and dose proportionality data for anti-PD-1 antibodies and anti-PD-1 activatable antibodies of the embodiments.

Figure 34:
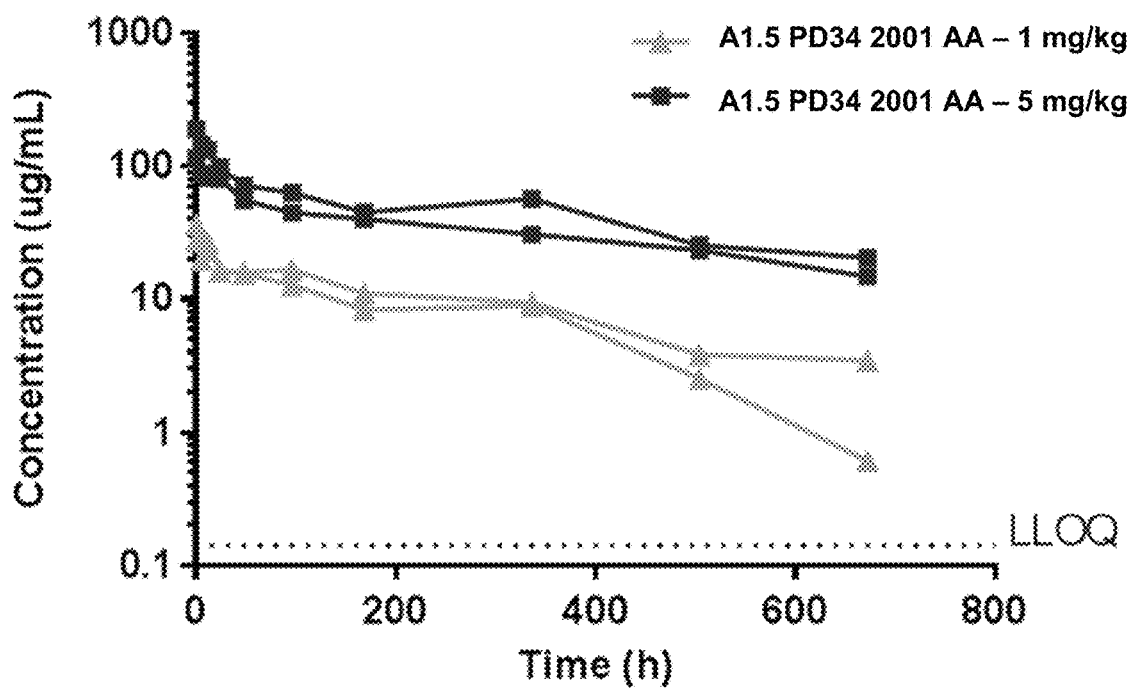
FIG. 34 is a graph and a table depicting the results of pharmacokinetic (PK) analysis of plasma samples from cynomolgus monkeys after dosing with a single IV bolus dose of either the A1.5 antibody or the activatable antibody referred to herein as A1.5 PD34 2001 at 1 mg/kg or at 5 mg/kg. Mean PK parameters shown for both A1.5 and A1.5 PD34 2001.

Briefly, female cynomolgus monkeys (n=2/group) were dosed with a single IV bolus dose of either the A1.5 antibody or the activatable antibody referred to herein as A1.5 PD34 2001 at 1 mg/kg or at 5 mg/kg. Plasma samples were analyzed for A1.5 and A1.5 PD34 2001 concentrations by a qualified anti-human sandwich ELISA. The results are shown in FIG. 34, where each line represents one individual. Mean PK parameters shown for both A1.5 and A1.5 PD34 2001. Similar results were seen for activatable antibodies A1.5 PD34 2012 and A1.5 PD34 2011 administered to cynomolgus monkeys in a similar study.

Example 31. Activatable Anti-Mouse PD-1 J43 Antibodies Reduce Incidence of Diabetes in NOD Mice Dosed with Anti-CTLA4 Antibody In this Example, anti-PD-1 J43 activatable antibodies were analyzed for the ability to protect from anti-PD-1 induction of diabetes in NOD mice when dosed concurrently with anti-CTLA-4 9D9 mIgG2b antibody (BioXCell cat #BE0164). The NOD mice, substrain NOD/ShiLtJ, were obtained from Jackson Laboratory at 4 weeks and acclimated on site for 1 week. At 5 weeks, mice were checked for diabetes prior to enrollment, grouped, and dosed as set forth in Table 23. As used herein, the antibody referred to as "J43 m2a EN" (and variations thereof) comprises a heavy chain (HC) of SEQ ID NO: 546; a light chain (LC) of SEQ ID NO: 543; and a constant region of SEQ ID NO: 1516. As used herein, the activatable antibody referred to as "J43 MP8-2 2012 m2a EN" is an activatable antibody comprising the J43 m2a EN antibody, the MP8-2 masking moiety (SEQ ID NO: 549), and the 2012 substrate (SEQ ID NO: 1101), and the activatable antibody referred to as "J43 MP8-2 2001 m2a EN" is an activatable antibody comprising the J43 m2a EN antibody, the MP8-2 masking moiety (SEQ ID NO: 549), and the 2001 substrate (SEQ ID NO: 214).

TABLE 23

| | | | | Dosing regimen | | | | |
|---|---|---|---|---|---|---|---|---|
| | | | | Treatment | | Dose | | |
| Group | Count | Article #1 | Dose (mg/kg) | Article #2 | Dose (mg/kg) | volume (mL/kg) | Schedule | Route |
| 1 | 8 | mIgG1 MOPC-21 | 10 | mIgG2b MPC-11 | 10 | 10 | d0, d4, d7 | IP |
| 2 | 8 | Anti-CTLA4 9D9 mIgG2b | 10 | mIgG1 MOPC-21 | 10 | 10 | d0, d4, d7 | IP |
| 3 | 8 | Anti-PD-1 (J43 m2a EN) | 10 | mIgG2b MPC-11 | 10 | 10 | d0, d4, d7 | IP |
| 4 | 8 | Anti-PD-1 (J43 m2a EN) | 1 | mIgG2b MPC-11 | 10 | 10 | d0, d4, d7 | IP |
| 5 | 8 | Anti-PD-1 (J43 m2a EN) | 10 | Anti-CTLA4 9D9 mIgG2b | 10 | 10 | d0, d4, d7 | IP |
| 6 | 8 | Anti-PD-1 (J43 m2a EN) | 1 | Anti-CTLA4 9D9 mIgG2b | 10 | 10 | d0, d4, d7 | IP |
| 7 | 8 | J43 MP8-2 2012 m2a EN | 10 | mIgG2b MPC-11 | 10 | 10 | d0, d4, d7 | IP |
| 8 | 8 | J43 MP8-2 2012 m2a EN | 10 | Anti-CTLA4 9D9 mIgG2b | 10 | 10 | d0, d4, d7 | IP |
| 9 | 8 | J43 MP8-2 2001 m2a EN | 10 | mIgG2b MPC-11 | 10 | 10 | d0, d4, d7 | IP |
| 10 | 8 | J43 MP8-2 2001 m2a EN | 10 | Anti-CTLA4 9D9 mIgG2b | 10 | 10 | d0, d4, d7 | IP |

Figure 35:
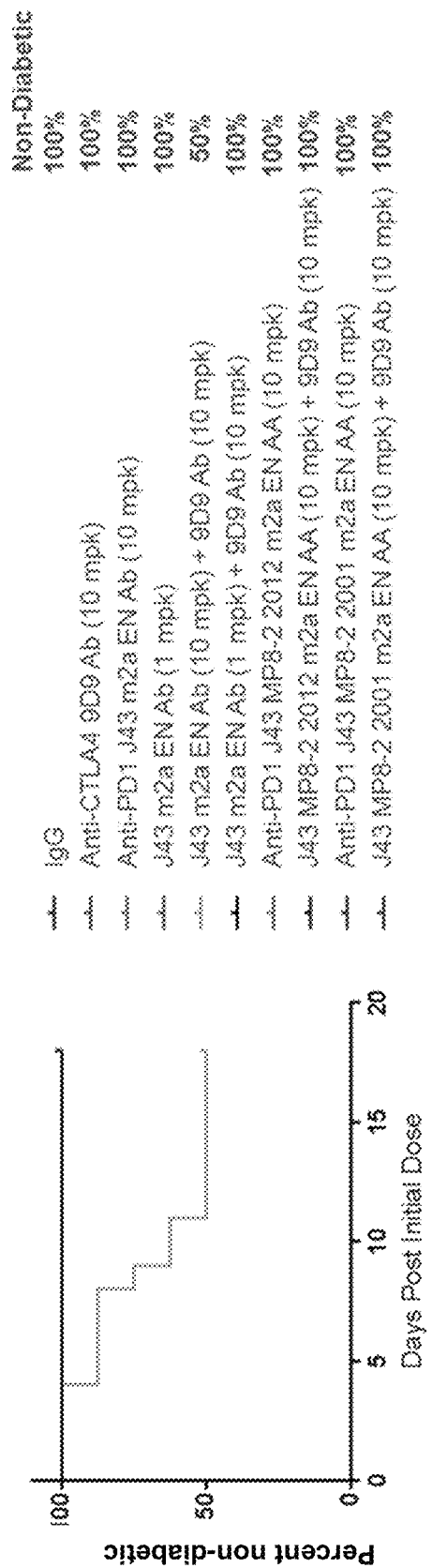
FIG. 35 is a graph depicting that the combination of 10 mg/kg anti-PD-1 J43 antibody plus 10 mg/kg anti-CTLA-4 antibody dosed on days 0, 4 and 7 induced diabetes in 50% of NOD mice by day eleven while the same dosing schedule of activatable anti-PD-1 J43 antibodies with CTLA-4 antibody resulted in no induction of diabetes to day eighteen.

FIG. 35 which plots % non-diabetic versus number of days post initial dose, shows that the combination of 10 mg/kg anti-PD-1 J43 antibody plus 10 mg/kg anti-CTLA-4 antibody dosed on days 0, 4 and 7 induced diabetes in 50% of NOD mice by day eleven while the same dosing schedule of activatable anti-PD-1 J43 antibodies with CTLA-4 antibody resulted in no induction of diabetes to day eighteen.

Example 32. Activatable Anti-Mouse PD1 J43 m2a EN Antibodies Show Enhanced Efficacy when Coadministered with Anti-CTLA4 Antibody in the MC38 Syngeneic Tumor Model This Example demonstrates that activatable antibodies of the embodiments are able to reduce the growth of MC38 syngeneic tumors as single agents and induce MC38 tumor regression when coadministered with anti-CTLA4 antibody 9D9 mIgG2b.

In this Example, anti-PD1 activatable antibodies J43 MP8-2 2011 m2a EN and J43 MP8-2 2012 m2a EN were analyzed for the ability to slow the growth of or, in combination with anti-CTLA4 antibody, induce regression in MC38 syngeneic tumors. As used herein, the antibody referred to as "J43 m2a EN" (and variations thereof) comprises a heavy chain (HC) of SEQ ID NO: 546; a light chain (LC) of SEQ ID NO: 543; and a constant region of SEQ ID NO: 1516. As used herein, the activatable antibody referred to as "J43 MP8-2 2011 m2a EN" is an activatable antibody comprising the J43 m2a EN antibody, the MP8-2 masking moiety (SEQ ID NO: 549), and the 2011 substrate (SEQ ID NO: 1100), and the activatable antibody referred to as "J43 MP8-2 2012 m2a EN" is an activatable antibody comprising the J43 m2a EN antibody, the MP8-2 masking moiety (SEQ ID NO: 549), and the 2012 substrate (SEQ ID NO: 1101).

The mouse colon carcinoma cell line MC38 was obtained from ATCC. MC38 cells were grown in RPMI-1640 supplemented with 10% fetal bovine serum at 37° C. in an atmosphere of 5% $CO_2$ in air. Cells were harvested during the logarithmic growth period, resuspended in PBS with proper cell concentration, and kept on ice for tumor induction.

Each mouse was inoculated subcutaneously at the right flank with $1.5 \times 10^6$ MC38 cells in PBS for tumor development. The treatments were started when the mean tumor size reached approximately 60 mm³ (45-80 mm³). Tumor sizes were measured twice weekly in two dimensions using a caliper, and the volume was expressed in mm³ using the formula: $V = 0.5 \, a \times b^2$ where a and b are the long and short diameters of the tumor, respectively.

The mice were grouped and dosed as set forth in Table 24.

TABLE 24

| Group | Count | Treatment | Dose (mg/kg) | Dose volume (mL/kg) | Schedule | Route |
|---|---|---|---|---|---|---|
| 1 | 10 | mIgG1 MOPC-21 + mIgG12b MPC-11 | 10 + 10 | 10 | b.i.w. for 3 weeks | IP |
| 2 | 10 | Anti-CTLA4 9D9 mIgG2b | 10 | 10 | b.i.w. for 3 weeks | IP |
| 3 | 10 | Anti-PD-1 (J43 m2a EN) | 10 | 10 | b.i.w. for 3 weeks | IP |
| 4 | 10 | J43 MP8-2 2012 m2a EN | 10 | 10 | b.i.w. for 3 weeks | IP |
| 5 | 10 | J43 MP8-2 2011 m2a EN | 10 | 10 | b.i.w. for 3 weeks | IP |
| 6 | 10 | Anti-PD-1 (J43 m2a EN) + Anti-CTLA4 9D9 mIgG2b | 10 + 10 | 10 | b.i.w. for 3 weeks | IP |
| 7 | 10 | J43 MP8-2 2012 m2a EN + Anti-CTLA4 9D9 mIgG2b | 10 + 10 | 10 | b.i.w. for 3 weeks | IP |
| 8 | 10 | J43 MP8-2 2011 m2a EN + Anti-CTLA4 9D9 mIgG2b | 10 + 10 | 10 | b.i.w. for 3 weeks | IP |

Figure 36:
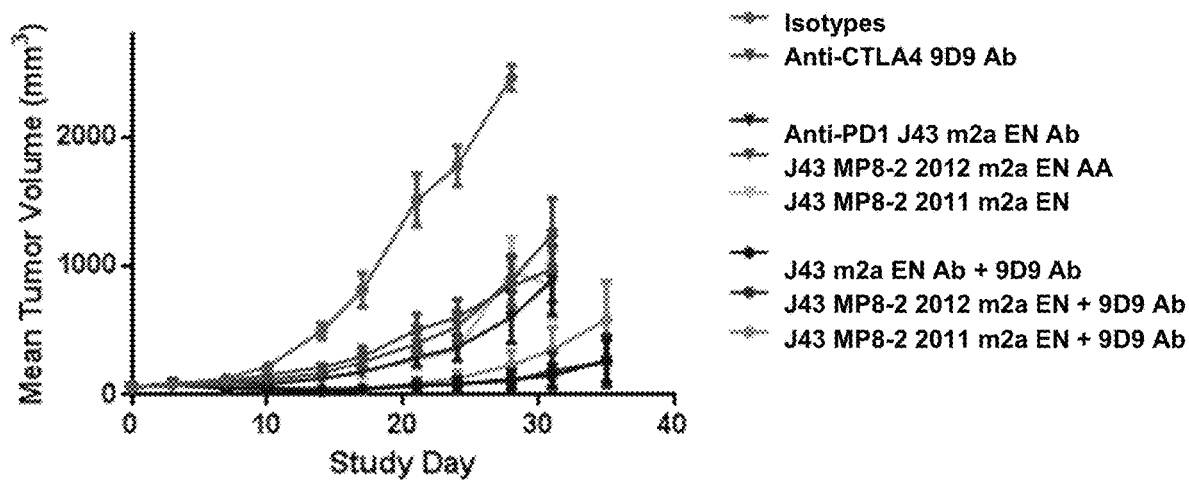
FIG. 36 is a graph depicting that the anti-PD1 activatable antibodies MP8-2 2012 m2a EN and MP8-2 2011 m2a EN inhibit the growth of MC38 syngeneic tumors similar to positive control anti-PD1 antibody J43 m2a EN, both as single agents and in combination with anti-CTLA4 antibody 9D9 mIgG2b.

FIG. 36, which plots tumor volume versus number of days post initial dose, demonstrates that anti-PD1 activatable antibodies MP8-2 2012 m2a EN and MP8-2 2011 m2a EN inhibit the growth of MC38 syngeneic tumors similar to positive control anti-PD1 antibody J43 m2a EN both as single agents and in combination with anti-CTLA4 antibody 9D9 mIgG2b (BioXCell, West Lebanon, N.H.).

Example 33. Activatable Anti-Mouse PD1 J43 m2a EN Antibodies Show Durable Anti-Tumor Activity when Coadministered with Anti-CTLA4 Antibody in the MC38 Syngeneic Tumor Model This Example demonstrates anti-PD-1 activatable antibodies of the embodiments in combination with anti-CTLA4 antibodies induce durable anti-tumor complete responses in the MC38 syngeneic tumor model.

In this Example, all animals treated with combinations of anti-CTLA4 and anti-PD1 agents from Example 28 that showed sustained tumor regression ((i) anti-PD-1 J43 m2aEN+anti-CTLA4 9D9 mIgG2b (referred to in FIG. 37 as "anti-PD-1 J43 m2aEN Antibody"+"anti-CTLA4 9D9 mIgG2b Antibody") (n=8), (ii) activatable antibody anti-PD-1 J43 MP8-2 2012 m2a EN+anti-CTLA4 9D9 mIgG2b (referred to in FIG. 37 as "J43 MP8-2 2012 m2a EN AA"+"anti-CTLA4 9D9 mIgG2b Antibody" where AA stands for activatable antibody) (n=8), and activatable antibody anti-PD-1 J43 MP8-2 2011 m2a EN+anti-CTLA4 9D9 mIgG2b (referred to in FIG. 37 as "J43 MP8-2 2011 m2a EN AA"+"anti-CTLA4 9D9 mIgG2b Antibody" where AA stands for activatable antibody) (n=6)) were implanted at day 38 with $1.5 \times 10^6$ MC38 tumor cells in the left flank opposite to the original MC38 implantation. Five untreated mice were implanted with $1.5 \times 10^6$ MC38 tumor cells to confirm tumorigenic activity of the MC38 cells.

Figure 37:
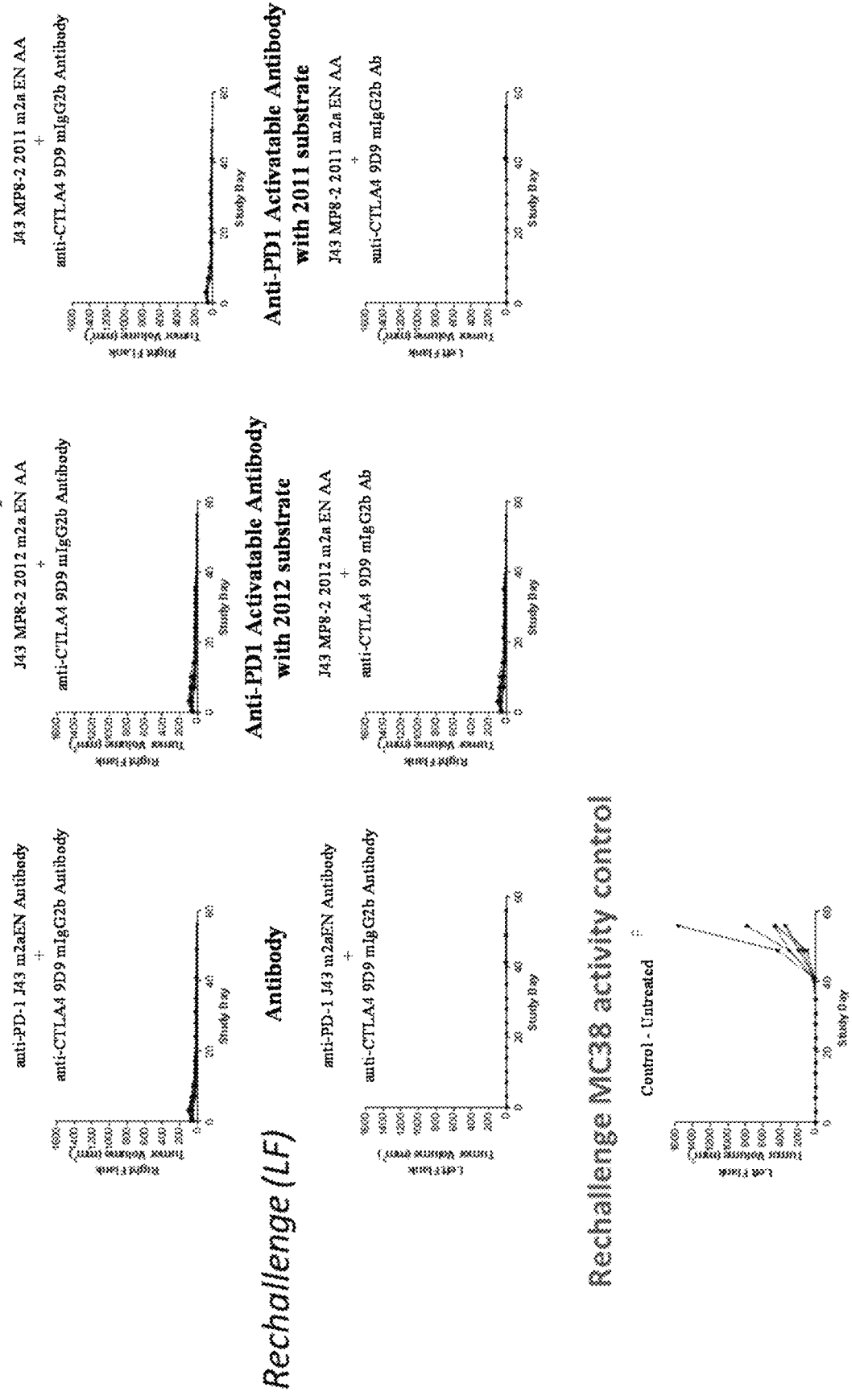
FIG. 37 is a series of graphs depicting that combination CTLA4 antibody and J43 activatable antibody treatment protects mice against rechallenge with MC38 tumor cells.

FIG. 37 shows that no mice previously treated with combinations of anti-PD1 and anti-CTLA4 agents showed regrowth of the original tumor sites (right flank) or growth of new tumors (left flank) while all five of the untreated control mice showed rapid tumor growth.

Example 34. Activatable Anti-Mouse PD-1 J43 Antibodies Reduce Incidence of Diabetes in NOD Mice Co-Dosed with Anti-CTLA4 Antibody This Example demonstrates that anti-PD-1 activatable antibodies of the embodiments in combination with anti-CTLA4 antibodies protected NOD mice from PD1 m2a EN-mediated induction of diabetes.

In this Example, anti-PD-1 J43 activatable antibody MP8-2 2011 m2aEN was analyzed for the ability to protect from anti-PD-1 induction of diabetes in NOD mice when dosed concurrently with anti-CTLA-4 9D9 mIgG2b antibody (BioXcell cat #BE0164). The NOD mice, substrain NOD/ShiLtJ, were obtained from Jackson Laboratory at 4 weeks and acclimated on site for 1 week. At 5 weeks, mice were checked for diabetes prior to enrollment, grouped, and dosed as set forth in Table 25.

TABLE 25

Dosing regimen

| Group | Count | Treatment Article #1 | Dose (mg/kg) | Article #2 | Dose (mg/kg) | Dose volume (mL/kg) | Schedule | Route |
|---|---|---|---|---|---|---|---|---|
| 1 | 8 | Anti-CTLA4 9D9 mIgG2b | 10 | mIgG1 MOPC-21 | 10 | 10 | d0, d4, d7 | IP |
| 2 | 8 | Anti-PD-1 (J43 m2a EN) | 10 | mIgG2b MPC-11 | 10 | 10 | d0, d4, d7 | IP |
| 3 | 8 | Anti-PD-1 (J43 m2a EN) | 10 | Anti-CTLA4 9D9 mIgG2b | 10 | 10 | d0, d4, d7 | IP |
| 4 | 8 | J43 MP8-2 2011 m2a EN | 10 | mIgG2b MPC-11 | 10 | 10 | d0, d4, d7 | IP |
| 5 | 8 | J43 MP8-2 2011 m2a EN | 10 | Anti-CTLA4 9D9 mIgG2b | 10 | 10 | d0, d4, d7 | IP |

Figure 38:
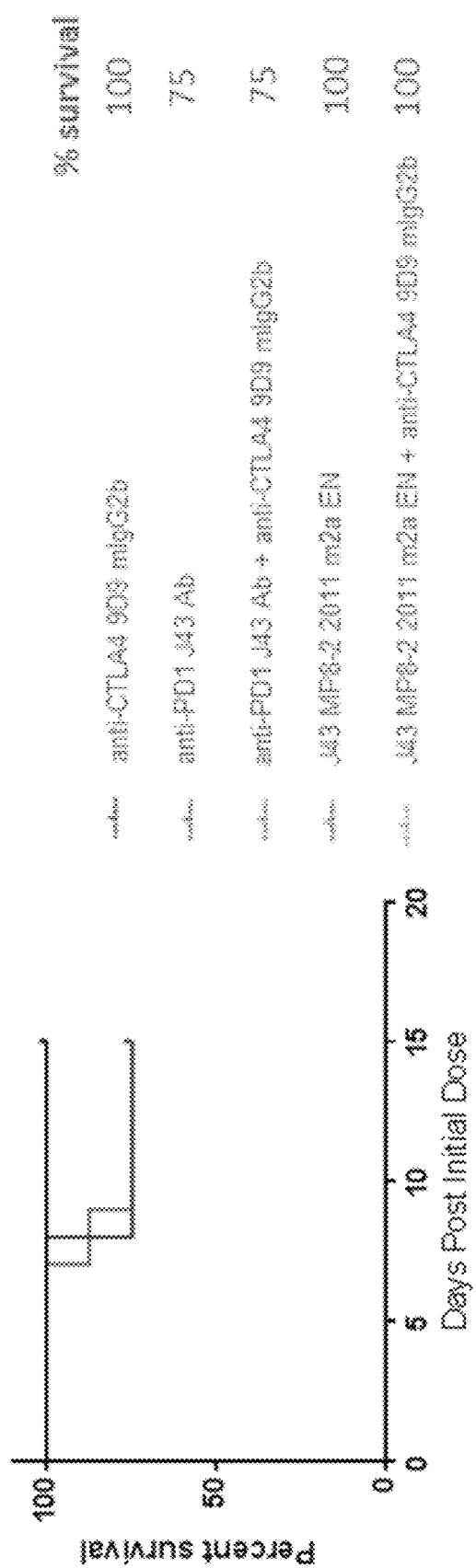
FIG. 38 is a graph depicting that an anti-PD-1 antibody administered alone or in combination with an anti-CTLA4 antibody induced diabetes in NOD mice, whereas an anti-PD-1 activatable antibody as a single agent or in combination with an anti-CTLA4 antibody resulted in no induction of diabetes to day fifteen.

FIG. 38, which plots % non-diabetic versus number of days post initial dose, shows that the single agent anti-PD-1 J43 antibody (referred to in the figure as "anti-PD1 J43 Ab") and the combination of 10 mg/kg anti-PD-1 J43 antibody plus 10 mg/kg anti-CTLA4 antibody (referred to in the figure as "anti-PD1 J43 Ab"+"anti-CTLA4 9D9 mIgG2b") dosed on days 0, 4 and 7 induced diabetes in 25% of NOD mice by day nine. In contrast, the same dosing schedule of activatable antibody anti-PD-1 J43 MP8-2 2011 m2a EN (referred to in the figure as "J43 MP8-2 2011 m2a EN AA" where AA stands for activatable antibody) as a single agent or in combination with anti-CTLA4 antibody (referred to in the figure as "J43 MP8-2 2011 m2a EN AA+"anti-CTLA4 9D9 mIgG2b" where AA stands for activatable antibody) resulted in no induction of diabetes to day fifteen.

Example 35. Anti-PD-1 Nivolumab Activatable Antibodies of the Embodiments are Functionally Masked in a Human T-Cell Restimulation Assay This Example describes the effect of masking moieties on the biological function of the anti-PD-1 nivolumab antibody.

PBMCs from a CMV-positive donor (Hemacare) were plated at $2\times10^5$ cells/well in the presence of CMV viral lysate (Astarte) and either anti-PD-1 antibody A1.5, anti-PD-1 activatable antibody A1.5 PD34 2001, anti-PD-1 antibody nivolumab (NV1), anti-PD-1 nivolumab activatable antibody NV1 NV07 2001, or an hIgG4 isotype control antibody. After four days, supernatant was removed from each well and IFN-gamma levels were assayed using an IFN-gamma ELISA kit (Life Technologies, Carlsbad, Calif.).

Figure 39:
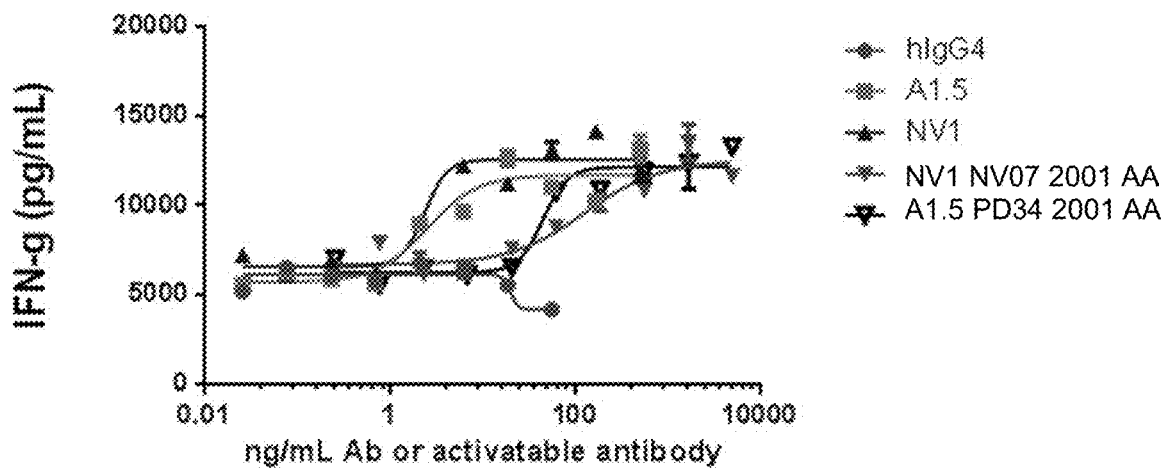
FIG. 39 is a graph demonstrating that anti-PD-1 activatable A1.5 and activatable nivolumab antibodies of the embodiments enhance IFN-gamma production in a CMV T cell restimulation assay as compared to a control antibody, but not to the extent effected by anti-PD-1 antibody A1.5 or nivolumab.

FIG. 39 demonstrates that the anti-PD-1 activatable antibody A1.5 PD34 2001 (referred to in the figure as "A1.5 PD34 2001 AA" where AA stands for activatable antibody) and anti-PD1 nivolumab activatable antibody NV1 NV07 2001 (referred to in the figure as "NV1 NV07 2001 AA" where AA stands for activatable antibody) effected increased CMV-stimulated IFN-gamma secretion compared to the control hIgG4 antibody (referred to in the figure as hIgG4) but decreased potency relative to anti-PD-1 parental antibody A1.5 (referred to in the figure as A1.5) or anti-PD-1 parental antibody nivolumab (referred to in the figure as NV1).

Example 36. Anti-PD-1 Pembrolizumab Activatable Antibodies of the Embodiments are Functionally Masked in a Human T-Cell Restimulation Assay This example describes the effect of masking moieties on the biological function of the anti-PD-1 pembrolizumab antibody.

PBMCs from a CMV-positive donor (Hemacare) were plated at $2\times10^5$ cells/well in the presence of 4 ug/ml CMV viral lysate (Astarte) and either anti-PD-1 antibody A1.5, anti-PD-1 antibody pembrolizumab (PM1), anti-PD-1 pembrolizumab activatable antibody PM1 PM07 2001, or an hIgG4 isotype control antibody. After four days, supernatant was removed from each well and IFN-gamma levels were assayed using an IFN-gamma ELISA kit (Life Technologies, Carlsbad, Calif.).

Figure 40:
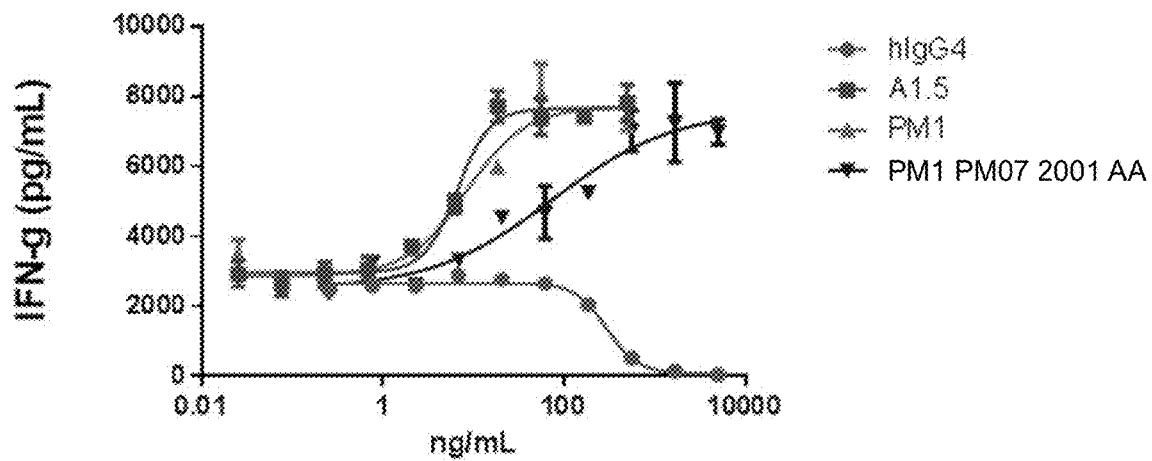
FIG. 40 is a graph demonstrating that an anti-PD-1 activatable pembrolizumab antibody of the embodiments enhances IFN-gamma production in a CMV T cell restimulation assay as compared to a control antibody, but not to the extent effected by anti-PD-1 antibody A1.5 or pembrolizumab.

FIG. 40 demonstrates that anti-PD1 pembrolizumab activatable antibody PM1 PM07 2001 (referred to in the figure as "PM1 PM07 2001 AA" where AA stands for activatable antibody) effected increased CMV-stimulated IFN-gamma secretion compared to the control hIgG4 antibody (referred to in the figure as hIgG4) but decreased potency relative to anti-PD-1 parental antibody A1.5 (referred to in the figure as A1.5) or anti-PD-1 parental antibody pembrolizumab (referred to in the figure as PM1).

Other Embodiments

While the invention has been described in conjunction with the detailed description thereof, the foregoing description is intended to illustrate and not limit the scope of the invention, which is defined by the scope of the appended claims. Other aspects, advantages, and modifications are within the scope of the following.

SEQUENCE LISTING (2062 sequences)

SEQ ID NO: 1 - protein, 119 aa, Artificial Sequence
  chemically synthesized
EVKLVESGGGLVKPGGSLKLSCAASGFTFSGYAMSWVRQTPAKRLEWVAYISNSGGNAHYPDSVKGRFTISRDNAKNTLYLQMSSLRSEDTAMYYCTREDYGTSPFVYWGQGTLVTVSA

SEQ ID NO: 2 - DNA, 357 bp, Artificial Sequence
  chemically synthesized
gaagtgaagctggtggagtctgggggaggcttagtgaaacctggagggtccctgaaactctcctgtgcagcctctggattcactttcagtggctatgccatgtcttgggttcgccagactccggcgaagaggctggagtgggtcgcatacattagtaatagtggtggtaacgcccactatccagacagtgtaaagggccgattcaccatctccagagacaatgccaagaacaccctatacctgcaaatgagcagtctgaggtctgaggacacggccatgtattactgtacaagagaggactacggtactagtccttttgtttactggggccaagggactctggtcactgtctctgca

SEQ ID NO: 3 - protein, 111 aa, Artificial Sequence
  chemically synthesized
DIVLTQSPASLAVSLGQRTTISCRASESVDNYGISFMNWFQQKPGQPPKLLIYAASNQGSGVPARFSGSGSGTDFSLNIHPMEEDDTAVYFCQQSKDVPWTFGGGTKLEIR

SEQ ID NO: 4 - DNA, 334 bp, Artificial Sequence
  chemically synthesized
gacattgtgctgacccaatctccagcttctttggctgtgtctcttgggcagaggaccaccatctcctgcagagccagcgaaagtgttgataattatggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcagtgtatttctgtcagcaaagtaaggacgttccgtggacgttcggtggaggcaccaagctggaaatcagac

SEQ ID NO: 5 - protein, 116 aa, Artificial Sequence
  chemically synthesized
EVQLQQSGPELVKPGDSVKMSCKASGYTFTDYYMDWVKQSHGKSLEWIGYIYPKNGGSSYNQKFKGKATLTVDKSSSTAYMELHSLTSEDSAVYYCARKVVATDYWGQGTTLTVSS

SEQ ID NO: 6 - DNA, 348 bp, Artificial Sequence
  chemically synthesized
gaggtccagctgcaacagtctggacctgagctggtgaagcctggggattcagtgaagatgtcctgcaaggcttctggctacacattcactgactactacatggactgggtgaagcagagccatggaaagagccttgagtggattggatatatttatcctaaaaatggtggttccagctacaatcagaagttcaagggcaaggccacattgactgtagacaagtcctccagcacagcctacatggagctccacagcctgacatctgaggactctgcagtctattactgtgcaagaaaggtcgtagctacggactactggggccaaggcaccactctcacagtctcctca

SEQ ID NO: 7 - protein, 113 aa, Artificial Sequence
  chemically synthesized
DIVMSQSPSSLAVSVGEKVTMSCKSSQSLLYSSNQKNYLAWYQQKPGQSPKLLIFWASIRESGVPDRFTGSGSGTDFTLTISSVKAEDRAVYYCQQCDSYPWTFGGGTKLEIK

SEQ ID NO: 8 - DNA, 340 bp, Artificial Sequence
  chemically synthesized
gacattgtgatgtcacagtctccatcctccctagctgtgtcagttggagagaaggttactatgagctgcaagtccagtcagagccttttatatagtagcaatcaaaagaactacttggcctggtaccagcagaaaccagggcagtctcctaaactgctgattttctgggcatctattagggaatctggggtccctgatcgcttcacaggcagtggatctgggacagatttcactctcaccatcagcagtgtgaaggctgaagaccgggcagtttattactgtcagcaatgtgatagctatccgtggacgttcggtggaggcaccaaactggaaatcaaac

SEQ ID NO: 9 - protein, 119 aa, Artificial Sequence
  chemically synthesized
EVKLVESGGGLVKPGGSLKLSCAASGFTFSNYAMSWVRQTPAKRLEWVAYISNGGGDTHYPDSLKGRFTVSRDNAKNTLYLQMSSLKSEDTAMYYCARENYGTSPFVYWGQGTLVTVSA

SEQ ID NO: 10 - DNA, 357 bp, Artificial Sequence
  chemically synthesized
gaagtgaagctggtggagtctgggggaggcttagtgaaacctggagggtccctgaaactctcctgtgcagcctctggattcactttcagtaactatgccatgtcttgggttcgccagactccggcgaagaggctggagtgggtcgcatacattagtaatggtggtggtgacacccactatccagacagtttaaagggccgattcaccgtctccagagacaatgccaagaacaccctgtacctacaaatgagcagtctgaagtctgaggacacggccatgtattactgtgcaagagaaaactacggtactagtccctttgtttactggggccaagggactctggtcactgtctctgca

SEQ ID NO: 11 - protein, 111 aa, Artificial Sequence
  chemically synthesized
DIVLTQSPASLAVSLGQRATISCRASESVDNYGISFMNWFQQKPGQPPKLLIYAASNQGSGVPARFSGSGSGTDFSLNIHPMEEDDTAMYFCQQSKDVPWTFGGGTKLEIK

SEQ ID NO: 12 - DNA, 334 bp, Artificial Sequence
  chemically synthesized
gacattgtgctgacccaatctccagcttctttggctgtgtctctagggcagagggccaccatctcctgcagagccagcgaaagtgttgataattatggcattagttttatgaactggttccaacagaaaccaggacagccacccaaactcctcatctatgctgcatccaaccaaggatccggggtccctgccaggtttagtggcagtgggtctgggacagacttcagcctcaacatccatcctatggaggaggatgatactgcaatgtatttctgtcagcaaagtaaagatgttccgtggacgttcggtggaggcaccaagctggaaatcaaac

SEQ ID NO: 13 - protein, 116 aa, Artificial Sequence
  chemically synthesized
EVQLVESGGGLVKSGGSLKLSCAHSGFSFSSYDMSWVRQTPAKRLEWVATISGGGRYTYYPDSVKGRFTISRDNAKNTLYLQMSGLRSEDTAMYYCASNYYGFDYWGQGTTLTVSS

SEQ ID NO: 14 - DNA, 348 bp, Artificial Sequence
  chemically synthesized
gaagtgcagctggtggagtctgggggaggcttagtgaagtctggagggtccctgaaactctcctgtgcgcattctggattcagttttagtagttatgacatgtcttgggttcgccagactccggcgaagaggctggagtgggtcgcaaccattagtggtggtggtcgttacacctactatccagacagtgtgaagggccgattcaccatctccagagacaatgccaagaacaccctgtacctgcaaatgagcggtctgaggtctgaggacacagccatgtattactgtgcaagtaattactacggttttgactactggggccaaggcaccactctcacagtctcttca

SEQ ID NO: 15 - protein, 107 aa, Artificial Sequence
  chemically synthesized
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPWTFGGGTKLEIK

SEQ ID NO: 16 - DNA, 322 bp, Artificial Sequence
  chemically synthesized
gatattgtgatgacccagtctcacaaattcatgtccacatcagtaggagacagggtcagcatcacctgcaaggccagtcaggatgtgggtactgctgtagcctggtatcaacagaaaccagggcaatctcctaaactactgatttactgggcatccacccggcacactggagtccctgatcgcttcacgggcagtggatctgggacagatttcactctcaccattagcaatgtgcagtctgaagacttggcagattatttctgtcagcaatatagcagctatccgtggacgttcggtggaggcaccaagctggaaatcaaac

SEQ ID NO: 17 - protein, 116 aa, Artificial Sequence
  chemically synthesized
KVMLVESGGDLVKPGGSLKLSCAASGFTFSSYGMSWVRQTPEKRLEWVATISGGGRDIYYADTVKGRFTISRDNAKNTLYLQMSSLRSEDTALYFCARLYLGFDYWGQGTTLTVSS

SEQ ID NO: 18 - DNA, 348 bp, Artificial Sequence
  chemically synthesized
aaagtgatgctggtggagtctgggggagacttagtgaagcctggagggtccctgaaactctcctgtgcagcctctggattcactttcagtagctatggcatgtcttgggttcgccagactccggagaagaggctggagtgggtcgcaaccattagtggtggtggtagagacatctactacgcagacactgtgaagggccgattcaccatctccagagacaatgccaagaacaccctgtacctacaaatgagcagtctgaggtctgaggacacggccttgtatttctgtgcaaggctctacctggggtttgactactggggccaaggcaccactctcacagtctcctca

SEQ ID NO: 19 - protein, 107 aa, Artificial Sequence
  chemically synthesized
DIQMTQSPASQSASLGESVTITCLASQTIGTWLAWYQQKPGKSPQLLIYAATSLADGVPSRFSGSGSGTKFSFKISSLQAEDFVSYYCQQLYSIPWTFGGGTKLEIK

SEQ ID NO: 20 - DNA, 322 bp, Artificial Sequence
  chemically synthesized
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttatgctgcaaccagcttggcagatggggtcccatcaaggttcagtggtagtggatctggcacaaaattttctttcaagatcagcagcctacaggctgaagattttgtaagttattactgtcaacaactttacagtattccgtggacattcggtggaggcaccaagctggaaatcaaac

SEQ ID NO: 21 - protein, 119 aa, Artificial Sequence
  chemically synthesized
EVQLVESGGGLVQPGGSLRLSCAASGFTFSGYAMSWVRQAPGKGLEWVAYISNSGGNAHYADSVKGRFTISRDNSKNTLYLQMNSLRAEDTAVYYCTREDYGTSPFVYWGQGTLVTVSS

SEQ ID NO: 22 - DNA, 357 bp, Artificial Sequence
  chemically synthesized
gaagtgcagctggtggaatctggcggcggactggtgcagcctggcggatctctgagactgagctgtgccgccagcggcttcacctttagcggctacgccatgagctgggtgcgccaggctcctggcaaaggcctggaatgggtggcctacatcagcaacagcggcggcaatgcccactacgccgatagcgtgaagggccggttcaccatcagccgggacaacagcaagaacaccctgtacctgcagatgaacagcctgcgggccgaggacaccgccgtgtactactgcaccagagaggactacggcaccagccccttcgtgtattggggccagggtaccctcgtgaccgtctcctca

SEQ ID NO: 23 - protein, 119 aa, Artificial Sequence
  chemically synthesized
EVQLVESGGGLVQPGGSLRLSCAASGFTFSGYAMSWVRQAPGKGLEWVSYISNSGGNAHYADSVKGRFTISRDNSKNTLYLQMNSLRAEDTAVYYCAKEDYGTSPFVYWGQGTLVTVSS

SEQ ID NO: 24 - DNA, 357 bp, Artificial Sequence
  chemically synthesized
gaagtgcagctggtggaatctggcggcggactggtgcagcctggcggatctctgagactgagctgtgccgccagcggcttcacctttagcggctacgccatgagctgggtgcgccaggctcctggcaaaggcctggaatgggtgagttacatcagcaacagcggcggcaatgcccactacgccgatagcgtgaagggccggttcaccatcagccgggacaacagcaagaacaccctgtacctgcagatgaacagcctgcgggccgaggacaccgccgtgtactactgcgccaaggaggactacggcaccagccccttcgtgtattggggccagggtaccctcgtgaccgtctcctca

SEQ ID NO: 25 - protein, 119 aa, Artificial Sequence
  chemically synthesized
EVQLVESGGGLVQPGGSLRLSCAASGFTFSGYAMSWVRQAPGKGLEWVAYISNSGGNTHYADSVKGRFTISRDNSKNTLYLQMNSLRAEDTAVYYCAREDYGTSPFVYWGQGTLVTVSS

SEQ ID NO: 26 - DNA, 357 bp, Artificial Sequence
  chemically synthesized
gaagtgcagctggtggaatctggcggcggactggtgcagcctggcggatctctgagactgagctgtgccgccagcggcttcacctttagcggctacgccatgagctgggtgcgccaggctcctggcaaaggcctggaatgggtggcctacatcagcaacagcggcggcaatacccactacgccgatagcgtgaagggccggttcaccatcagccgggacaacagcaagaacaccctgtacctgcagatgaacagcctgcgggccgaggacaccgccgtgtactactgcgccagagaggactacggcaccagccccttcgtgtattggggccagggtaccctcgtgaccgtctcctca

SEQ ID NO: 27 - protein, 119 aa, Artificial Sequence
  chemically synthesized
EVQLVESGGGLVQPGGSLRLSCAASGFTFSGYAMSWVRQAPGKGLEWVAYISNSGGNTHYADSLKGRFTVSRDNSKNTLYLQMNSLRAEDTAVYYCAREDYGTSPFVYWGQGTLVTVSS

SEQ ID NO: 28 - DNA, 357 bp, Artificial Sequence
  chemically synthesized
gaagtgcagctggtggaatctggcggcggactggtgcagcctggcggatctctgagactgagctgtgccgccagcggcttcacctttagcggctacgccatgagctgggtgcgccaggctcctggcaaaggcctggaatgggtggcctacatcagcaacagcggcggcaatacccactacgccgatagcctgaagggccggttcaccgtcagccgggacaacagcaagaacaccctgtacctgcagatgaacagcctgcgggccgaggacaccgccgtgtactactgcgccagagaggactacggcaccagccccttcgtgtattggggccagggtaccctcgtgaccgtctcctca

SEQ ID NO: 29 - protein, 116 aa, Artificial Sequence
  chemically synthesized
QVQLVQSGAEVKKPGASVKMSCKASGYTFTDYYMDWVRQAPGQGLEWIGYIYPKNGGSSYAQKFQGRATLTVDTSTSTAYMELSSLRSEDTAVYYCARKVVATDYWGQGTLLTVSS

SEQ ID NO: 30 - DNA, 348 bp, Artificial Sequence
  chemically synthesized
caggtgcagctggtgcagtctggcgccgaagtgaagaaaccaggcgccagcgtgaagatgagctgcaaggccagcggctacaccttcaccgactactacatggactgggtgcgccaggcccctggacagggactggaatggatcggctacatctaccccaagaacggcggcagcagctacgcccagaagttccagggcagagccaccctgaccgtggacaccagcacaagcaccgcctacatggaactgagcagcctgcggagcgaggacaccgccgtgtactactgcgccagaaaggtggtggccacagactactggggccagggtaccctgctgaccgtgtctagt

SEQ ID NO: 31 - protein, 116 aa, Artificial Sequence
  chemically synthesized
QVQLVQSGAEVKKPGASVKMSCKASGYTFTDYYMDWVRQAPGQGLEWIGYIYPKNGGSSYAQKFQGRATLTVDKSTSTAYMELSSLRSEDTAVYYCARKVVATDYWGQGTLLTVSS

SEQ ID NO: 32 - DNA, 348 bp, Artificial Sequence
  chemically synthesized
caggtgcagctggtgcagtctggcgccgaagtgaagaaaccaggcgccagcgtgaagatgagctgcaaggccagcggctacaccttcaccgactactacatggactgggtgcgccaggcccctggacagggactggaatggatcggctacatctaccccaagaacggcggcagcagctacgcccagaagttccagggcagagccaccctgaccgtggacaagagcaccagcaccgcctacatggaactgagcagcctgcggagcgaggacaccgccgtgtactactgcgccagaaaggtggtggccacagactactggggccagggtaccctgctgaccgtgtctagt

SEQ ID NO: 33 - protein, 119 aa, Artificial Sequence
  chemically synthesized
EVQLVESGGGLVQPGGSLRLSCAASGFTFSNYAMSWVRQAPGKGLEWVAYISNGGGDTHYADSLKGRFTVSRDNSKNTLYLQMNSLRAEDTAVYYCARENYGTSPFVYWGQGTLVTVSS

SEQ ID NO: 34 - DNA, 357 bp, Artificial Sequence
  chemically synthesized
gaagtgcagctggtggaatctggcggcggactggtgcagcctggcggatctctgagactgagctgtgccgccagcggcttcaccttcagcaactacgccatgagctgggtgcgccaggcccctggaaaaggcctggaatgggtggcctacatcagcaacggcggaggcgatacccactacgccgatagcctgaagggccggttcaccgtgtccagagacaacagcaagaacaccctgtacctgcagatgaacagcctgcgggccgaggacaccgccgtgtactattgcgccagagagaactacggcaccagccccttcgtgtactggggccagggtaccctcgtgaccgtgtcctct

SEQ ID NO: 35 - protein, 119 aa, Artificial Sequence
  chemically synthesized
EVQLVESGGGLVQPGGSLRLSCAASGFTFSNYAMSWVRQAPGKGLEWVAYISNQGGDTHYADSLKGRFTVSRDNSKNTLYLQMNSLRAEDTAVYYCARENYGTSPFVYWGQGTLVTVSS

SEQ ID NO: 36 - DNA, 357 bp, Artificial Sequence
  chemically synthesized
gaagtgcagctggtggaatctggcggcggactggtgcagcctggcggatctctgagactgagctgtgccgccagcggcttcaccttcagcaactacgccatgagctgggtgcgccaggcccctggaaaaggcctggaatgggtggcctacatcagccaaggcggaggcgatacccactacgccgatagcctgaagggccggttcaccgtgtccagagacaacagcaagaacaccctgtacctgcagatgaacagcctgcgggccgaggacaccgccgtgtactattgcgccagagagaactacggcaccagccccttcgtgtactggggccagggtaccctcgtgaccgtgtcctct

SEQ ID NO: 37 - protein, 116 aa, Artificial Sequence
  chemically synthesized
EVQLVESGGGLVQPGGSLRLSCAHSGFSFSSYDMSWVRQAPGKGLEWVATISGGGRYTYYADSVKGRFTISRDNSKNTLYLQMNSLRAEDTAVYYCASNYYGFDYWGQGTLLTVSS

SEQ ID NO: 38 - DNA, 348 bp, Artificial Sequence
  chemically synthesized
gaagtgcagctggtggaatctggcggcggactggtgcagcctggcggatctctgagactgagctgtgcccacagcggcttcagcttcagcagctacgacatgagctgggtgcgccaggcccctggcaaaggactggaatgggtggccacaatcagcggcggaggccggtacacctactacgccgatagcgtgaagggccggttcaccatcagccgggacaacagcaagaacaccctgtacctgcagatgaacagcctgcgggccgaggacaccgccgtgtactactgcgccagcaactactacggcttcgactactggggccagggtaccctgctgaccgtgtcatct

SEQ ID NO: 39 - protein, 111 aa, Artificial Sequence
  chemically synthesized
DIQLTQSPSSLSASVGDRVTITCRASESVDNYGISFMNWFQQKPGKAPKLLIYAASNQGSGVPSRFSGSGSGTDFTLTISSMQPEDFATYYCQQSKDVPWTFGQGTKLEIK

SEQ ID NO: 40 - DNA, 333 bp, Artificial Sequence
  chemically synthesized
gacatccagctgacccagagccctagcagcctgtctgccagcgtgggcgacagagtgaccatcacctgtagagccagcgagagcgtggacaactacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 41 - protein, 111 aa, Artificial Sequence
  chemically synthesized
DIQLTQSPSSLSVSVGDRATITCRASESVDNYGISFMNWFQQKPGKAPKLLIYAASNQGSGVPSRFSGSGSGTDFTLTISSMQPEDFATYYCQQSKDVPWTFGQGTKLEIK

SEQ ID NO: 42 - DNA, 333 bp, Artificial Sequence
  chemically synthesized
gacatccagctgacccagagccctagcagcctgtccgtgtccgtgggcgacagagccaccatcacctgtagagccagcgagagcgtggacaactacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 43 - protein, 111 aa, Artificial Sequence
  chemically synthesized
DIQLTQSPSSLSASVGDRVTITCRASESVDQYGISFMNWFQQKPGKAPKLLIYAASNQGSGVPSRFSGSGSGTDFTLTISSMQPEDFATYYCQQSKDVPWTFGQGTKLEIK

SEQ ID NO: 44 - DNA, 333 bp, Artificial Sequence
  chemically synthesized
gacatccagctgacccagagccctagcagcctgtctgccagcgtgggcgacagagtgaccatcacctgtagagccagcgagagcgtggaccaatacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 45 - protein, 111 aa, Artificial Sequence
  chemically synthesized
DIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 46 - DNA, 333 bp, Artificial Sequence
  chemically synthesized
gacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 47 - protein, 111 aa, Artificial Sequence
  chemically synthesized
DIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 48 - DNA, 333 bp, Artificial Sequence
  chemically synthesized
gacatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 49 - protein, 111 aa, Artificial Sequence
  chemically synthesized
DIQLTQSPSSLSASVGDRVTITCRASESVDNYGISFMNWFQQKPGKAPKLLIYAASDQGSGVPSRFSGSGSGTDFTLTISSMQPEDFATYYCQQSKDVPWTFGQGTKLEIK

SEQ ID NO: 50 - DNA, 333 bp, Artificial Sequence
  chemically synthesized
gacatccagctgacccagagccctagcagcctgtctgccagcgtgggcgacagagtgaccatcacctgtagagccagcgagagcgtggacaactacggcatcagcttcatgaactggttccagcagaagcccggcaaggcccccaagctgctgatctacgccgccagcgatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 51 - protein, 111 aa, Artificial Sequence
  chemically synthesized
DIQLTQSPSSLSVSVGDRATITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 52 - DNA, 333 bp, Artificial Sequence
  chemically synthesized
gacatccagctgacccagagccctagcagcctgtccgtgtccgtgggcgacagagccaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 53 - protein, 111 aa, Artificial Sequence
  chemically synthesized
DIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKVEIK

SEQ ID NO: 54 - DNA, 333 bp, Artificial Sequence
  chemically synthesized
gacatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaaggtggaaatcaag

SEQ ID NO: 55 - protein, 111 aa, Artificial Sequence
  chemically synthesized
DIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPYTFGQGTKLEIK

SEQ ID NO: 56 - DNA, 333 bp, Artificial Sequence
  chemically synthesized
gacatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctacacctttggccagggtaccaagctggaaatcaag

SEQ ID NO: 57 - protein, 113 aa, Artificial Sequence
  chemically synthesized
DIQMTQSPSSLSASVGDRVTMTCKSSQSLLYSSNQKNYLAWYQQKPGKAPKLLIFWASIRESGVPSRFSGSGSGTDFTLTISSVQPEDFATYYCQQSDSYPWTFGQGTKLEIK

SEQ ID NO: 58 - DNA, 339 bp, Artificial Sequence
  chemically synthesized
gacatccagatgacccagagccccagcagcctgtctgccagcgtgggcgatagagtgaccatgacctgcaagagcagccagagcctgctgtactccagcaaccagaagaactacctggcctggtatcagcagaagcccggcaaggcccccaagctgctgatcttctgggccagcatccgggaaagcggcgtgcccagcagattttctggctctggcagcggcaccgacttcaccctgacaatcagcagcgtgcagcccgaggacttcgccacctactactgccagcagagcgacagctacccctggacctttggccagggtaccaagctggaaatcaag

SEQ ID NO: 59 - protein, 107 aa, Artificial Sequence
  chemically synthesized
DIQMTQSPSSLSASVGDRVTITCKASQDVGTAVAWYQQKPGKAPKLLIYWASTRHTGVPSRFSGSGSGTDFTLTISSVQPEDFATYYCQQYSSYPWTFGQGTKLEIK

SEQ ID NO: 60 - DNA, 321 bp, Artificial Sequence
  chemically synthesized
gacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctactgggccagcaccagacacaccggcgtgcccagcagattttctggcagcggctccggcaccgacttcaccctgacaatcagcagcgtgcagcccgaggacttcgccacctactactgccagcagtacagcagctacccctggacctttggccagggtaccaagctggaaatcaag

SEQ ID NO: 61 - protein, 107 aa, Artificial Sequence [sequence omitted]

SEQ ID NO: 62 - DNA, 321 bp, Artificial Sequence
  chemically synthesized
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 63 - protein, 327 aa, Artificial Sequence
  chemically synthesized
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - DNA, 981 bp, Artificial Sequence
  chemically synthesized
gctagcaccaagggcccatcggtcttccccctggcaccctgtagcagaagcaccagcgagtctacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcaccaagacctacacctgtaacgtggaccacaagcccagcaacaccaaggtggacaagcgggtggaatctaagtacggccctccctgccctccttgcccagcccctgaatttctggggggaccgtcagtcttcctcttccccccaaaacccaaggacaccctcatgatctcccggacccctgaggtcacatgcgtggtggtggacgtgagccaggaagaccctgaggtccagttcaactggtacgtggacggcgtggaggtgcataatgccaagacaaagccgcgggaggagcagttcaacagcacgtaccgtgtggtcagcgtcctcaccgtcctgcaccaggactggctgaatggcaaggagtacaagtgcaaggtctccaacaaaggcctgcccagctccatcgagaaaaccatctccaaagccaaagggcagccccgagaaccacaggtgtacaccctgcccccatcccaggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcagactcaccgtggacaagagcaggtggcaggaagggaacgtcttctcatgctccgtgatgcatgaggctctgcacaaccactacacgcagaagagcctctccctgtctctgggtaaa

SEQ ID NO: 65 - protein, 8 aa, Artificial Sequence
  chemically synthesized
GGGSSGGS

SEQ ID NO: 66 - protein, 15 aa, Artificial Sequence
  chemically synthesized
AMSGCSWSAFCPYLA

SEQ ID NO: 67 - protein, 15 aa, Artificial Sequence
  chemically synthesized
DVNCAIWYSVCTTVP

SEQ ID NO: 68 - protein, 15 aa, Artificial Sequence
  chemically synthesized
LVCPLYALSSGVCMG

SEQ ID NO: 69 - protein, 15 aa, Artificial Sequence
  chemically synthesized
SVNCRIWSAVCAGYE

SEQ ID NO: 70 - protein, 15 aa, Artificial Sequence
  chemically synthesized
MLVCSLQPTAMCERV

SEQ ID NO: 71 - protein, 15 aa, Artificial Sequence
  chemically synthesized
APRCYMFASYCKSQY

SEQ ID NO: 72 - protein, 15 aa, Artificial Sequence
  chemically synthesized
VGPCELTPKPVCNTY

SEQ ID NO: 73 - protein, 15 aa, Artificial Sequence
  chemically synthesized
ETCNQYERSSGLCFA

SEQ ID NO: 74 - protein, 15 aa, Artificial Sequence
  chemically synthesized
APRTCYTYQCSSFYT

SEQ ID NO: 75 - protein, 15 aa, Artificial Sequence
  chemically synthesized
GLCSWYLSSSGLCVD

SEQ ID NO: 76 - protein, 15 aa, Artificial Sequence
  chemically synthesized
VPWCQLTPRVMCMWA

SEQ ID NO: 77 - protein, 15 aa, Artificial Sequence
  chemically synthesized
NWLDCQFYSECSVYG

SEQ ID NO: 78 - protein, 15 aa, Artificial Sequence
  chemically synthesized
SCPLYVMSSFGGCWD

SEQ ID NO: 79 - protein, 15 aa, Artificial Sequence
  chemically synthesized
MSHCWMFSSSCDGVK

SEQ ID NO: 80 - protein, 15 aa, Artificial Sequence
  chemically synthesized
VSYCTWLIEVTCLRG

SEQ ID NO: 81 - protein, 15 aa, Artificial Sequence
  chemically synthesized
VLCAAYALSSGICGG

SEQ ID NO: 82 - protein, 15 aa, Artificial Sequence
  chemically synthesized
TTCNLYQQSSMFCNA

SEQ ID NO: 83 - protein, 15 aa, Artificial Sequence
  chemically synthesized
APRCYMFASYCKSQY

SEQ ID NO: 84 - protein, 15 aa, Artificial Sequence
  chemically synthesized
PCDQNPYFYPYVCHA

SEQ ID NO: 85 - protein, 15 aa, Artificial Sequence
  chemically synthesized
SVCPMYALSSMLCGA

SEQ ID NO: 86 - protein, 15 aa, Artificial Sequence
  chemically synthesized
LSVECYVFSRCSSLP

SEQ ID NO: 87 - protein, 14 aa, Artificial Sequence
  chemically synthesized
FYCTYLVSLTCHPQ

SEQ ID NO: 88 - protein, 15 aa, Artificial Sequence
  chemically synthesized
SMAGCQWSSFCVQRD

SEQ ID NO: 89 - protein, 15 aa, Artificial Sequence
  chemically synthesized
IYSCYMFASRCTSDK

SEQ ID NO: 90 - protein, 15 aa, Artificial Sequence
  chemically synthesized
SRCSVYEVSSGLCDW

SEQ ID NO: 91 - protein, 15 aa, Artificial Sequence
  chemically synthesized
GMCSAYAYSSKLCTI

SEQ ID NO: 92 - protein, 15 aa, Artificial Sequence
  chemically synthesized
MTTNTCNLLCQQFLT

SEQ ID NO: 93 - protein, 15 aa, Artificial Sequence
  chemically synthesized
FQPCLMFASSCFTSK

SEQ ID NO: 94 - protein, 15 aa, Artificial Sequence
  chemically synthesized
WNCHPAGVGPVFCEV

SEQ ID NO: 95 - protein, 15 aa, Artificial Sequence
  chemically synthesized
ALCSMYLASSGLCNK

SEQ ID NO: 96 - protein, 15 aa, Artificial Sequence
  chemically synthesized
NYLSCQFFQNCYETY

SEQ ID NO: 97 - protein, 15 aa, Artificial Sequence
  chemically synthesized
GWCLFSDMWLGLCSA

SEQ ID NO: 98 - protein, 15 aa, Artificial Sequence
  chemically synthesized
EFCARDWLPYQCSSF

SEQ ID NO: 99 - protein, 15 aa, Artificial Sequence
  chemically synthesized
TSYCSIEHYPCNTHH

SEQ ID NO: 100 - protein, 15 aa, Artificial Sequence
  chemically synthesized
PYICSSFPLDCQAGQ

SEQ ID NO: 101 - protein, 15 aa, Artificial Sequence
  chemically synthesized
VGCEWYMSSSGMCSR

SEQ ID NO: 102 - protein, 15 aa, Artificial Sequence
  chemically synthesized
EVCGGCSMQSVSCWP

SEQ ID NO: 103 - protein, 15 aa, Artificial Sequence
  chemically synthesized
FTECQLSPKAICMSN

SEQ ID NO: 104 - protein, 15 aa, Artificial Sequence
  chemically synthesized
KYCLFSEYVEGTCLN

SEQ ID NO: 105 - protein, 15 aa, Artificial Sequence
  chemically synthesized
SGCPMYAWGWDECWR

SEQ ID NO: 106 - protein, 15 aa, Artificial Sequence
  chemically synthesized
VDCPWYASSSAICSR

SEQ ID NO: 107 - protein, 15 aa, Artificial Sequence
  chemically synthesized
DMLLCQIRGSCAAWG

SEQ ID NO: 108 - protein, 15 aa, Artificial Sequence
  chemically synthesized
ECHPYQASASLWCGY

SEQ ID NO: 109 - protein, 15 aa, Artificial Sequence
  chemically synthesized
MMMGCMWSAWCPPSR

SEQ ID NO: 110 - protein, 15 aa, Artificial Sequence
  chemically synthesized
NAYFRCSLMCNMIMF

SEQ ID NO: 111 - protein, 15 aa, Artificial Sequence
  chemically synthesized
ACCKESVHSVHDCKR

SEQ ID NO: 112 - protein, 15 aa, Artificial Sequence
  chemically synthesized
ACIGINSYMSNYCYL

SEQ ID NO: 113 - protein, 15 aa, Artificial Sequence
  chemically synthesized
ANCSFLELTNKFCTI

SEQ ID NO: 114 - protein, 15 aa, Artificial Sequence
  chemically synthesized
AYCSYLMFASNPCII

SEQ ID NO: 115 - protein, 15 aa, Artificial Sequence
  chemically synthesized
CFTSKCPCLCYSLLA

SEQ ID NO: 116 - protein, 15 aa, Artificial Sequence
  chemically synthesized
CLCRDINCWLGCSKT

SEQ ID NO: 117 - protein, 15 aa, Artificial Sequence
  chemically synthesized
CWCDIYCSPYQCSSF

SEQ ID NO: 118 - protein, 15 aa, Artificial Sequence
  chemically synthesized
DCIYYYQQSANLCSY

SEQ ID NO: 119 - protein, 15 aa, Artificial Sequence
  chemically synthesized
DCTGVNYYIDKHCTN

SEQ ID NO: 120 - protein, 15 aa, Artificial Sequence
  chemically synthesized
DECHGYLRSSGLCGG

SEQ ID NO: 121 - protein, 15 aa, Artificial Sequence
  chemically synthesized
DICSAYAASSGFCYY

SEQ ID NO: 122 - protein, 15 aa, Artificial Sequence
  chemically synthesized
DIICVLTPTAWCGRT

SEQ ID NO: 123 - protein, 15 aa, Artificial Sequence
  chemically synthesized
DNCCMYCSWWIACRD

SEQ ID NO: 124 - protein, 15 aa, Artificial Sequence
  chemically synthesized
DSCQWYMLSADLCGT

SEQ ID NO: 125 - protein, 15 aa, Artificial Sequence
  chemically synthesized
DSVCFSSSSFLCHKS

SEQ ID NO: 126 - protein, 15 aa, Artificial Sequence
  chemically synthesized
DTMCAIWWTVCSGGR

SEQ ID NO: 127 - protein, 15 aa, Artificial Sequence
  chemically synthesized
ECTYQTSSFHEACMS

SEQ ID NO: 128 - protein, 15 aa, Artificial Sequence
  chemically synthesized
EGCNLYERSSYGCNN

SEQ ID NO: 129 - protein, 15 aa, Artificial Sequence
  chemically synthesized
EGCTAFAMSAGICGG

SEQ ID NO: 130 - protein, 15 aa, Artificial Sequence
  chemically synthesized
EQSCSLTPIAFCWSE

SEQ ID NO: 131 - protein, 15 aa, Artificial Sequence
  chemically synthesized
EWCNAYISSSKLCST

SEQ ID NO: 132 - protein, 15 aa, Artificial Sequence
  chemically synthesized
FEVCYMFASACRNGM

SEQ ID NO: 133 - protein, 15 aa, Artificial Sequence
  chemically synthesized
FSCSWYAESSSLCDI

SEQ ID NO: 134 - protein, 15 aa, Artificial Sequence
  chemically synthesized
FVCQMFEASSGLCGG

SEQ ID NO: 135 - protein, 15 aa, Artificial Sequence
  chemically synthesized
FYCPCCMFASSCGSR

SEQ ID NO: 136 - protein, 15 aa, Artificial Sequence
  chemically synthesized
FYCSYLPGASHQCSH

SEQ ID NO: 137 - protein, 15 aa, Artificial Sequence
  chemically synthesized
FYCSYLYMCEVCCYE

SEQ ID NO: 138 - protein, 15 aa, Artificial Sequence
  chemically synthesized
GFCTQHTVLTWCPTS

SEQ ID NO: 139 - protein, 15 aa, Artificial Sequence
  chemically synthesized
GSCPSYAVSAGLCYA

SEQ ID NO: 140 - protein, 15 aa, Artificial Sequence
  chemically synthesized
GSQCFLTPTAFCTHT

SEQ ID NO: 141 - protein, 15 aa, Artificial Sequence
  chemically synthesized
GTCHPYMQSSKICNN

SEQ ID NO: 142 - protein, 15 aa, Artificial Sequence
  chemically synthesized
GVECFVFTGGCGGYG

SEQ ID NO: 143 - protein, 15 aa, Artificial Sequence
  chemically synthesized
HELCNGHWVPCCWAY

SEQ ID NO: 144 - protein, 15 aa, Artificial Sequence
  chemically synthesized
ICDSYYAVSSGLCLL

SEQ ID NO: 145 - protein, 15 aa, Artificial Sequence
  chemically synthesized
IGCAWYVSSAGWCSP

SEQ ID NO: 146 - protein, 15 aa, Artificial Sequence
  chemically synthesized
INLCWMFASECGEHH

SEQ ID NO: 147 - protein, 15 aa, Artificial Sequence
  chemically synthesized
KCWLAEMTNLEHCNM

SEQ ID NO: 148 - protein, 15 aa, Artificial Sequence
  chemically synthesized
KHCSDFAYSSRLCDR

SEQ ID NO: 149 - protein, 15 aa, Artificial Sequence
  chemically synthesized
KVCSSYASSSGLCGW

SEQ ID NO: 150 - protein, 15 aa, Artificial Sequence
  chemically synthesized
LDSCYMFASYCVQAV

SEQ ID NO: 151 - protein, 15 aa, Artificial Sequence
  chemically synthesized
LLACHPIFVTVCQTR

SEQ ID NO: 152 - protein, 15 aa, Artificial Sequence
  chemically synthesized
LLSCPYNPEHVCHTS

SEQ ID NO: 153 - protein, 15 aa, Artificial Sequence
  chemically synthesized
LMCSLYALSSNLCGR

SEQ ID NO: 154 - protein, 15 aa, Artificial Sequence
  chemically synthesized
LMWCVLFLWSWCCRI

SEQ ID NO: 155 - protein, 15 aa, Artificial Sequence
  chemically synthesized
LPICHLTPTAVCTHI

SEQ ID NO: 156 - protein, 15 aa, Artificial Sequence
  chemically synthesized
LSNMCLAFGSCLYAW

SEQ ID NO: 157 - protein, 15 aa, Artificial Sequence
  chemically synthesized
LSRCHPIWYTICQNP

SEQ ID NO: 158 - protein, 15 aa, Artificial Sequence
  chemically synthesized
LTQCMSVHKECGGYE

SEQ ID NO: 159 - protein, 15 aa, Artificial Sequence
  chemically synthesized
LVNCRIWSWVCEEAT

SEQ ID NO: 160 - protein, 15 aa, Artificial Sequence
  chemically synthesized
LYCSWYQMSSAVCKE

SEQ ID NO: 161 - protein, 15 aa, Artificial Sequence
  chemically synthesized
MECGWYALSARFCEV

SEQ ID NO: 162 - protein, 15 aa, Artificial Sequence
  chemically synthesized
MTCSPYAMSAHFCNE

SEQ ID NO: 163 - protein, 15 aa, Artificial Sequence
  chemically synthesized
MVCSLYAYSASLCGA

SEQ ID NO: 164 - protein, 15 aa, Artificial Sequence
  chemically synthesized
NALCWSTFSWWCDMD

SEQ ID NO: 165 - protein, 15 aa, Artificial Sequence
  chemically synthesized
NFTCMLTPKAYCVQT

SEQ ID NO: 166 - protein, 15 aa, Artificial Sequence
  chemically synthesized
NGACIFTLSWCTNKT

SEQ ID NO: 167 - protein, 15 aa, Artificial Sequence
  chemically synthesized
NGCELYAAASGLCRT

SEQ ID NO: 168 - protein, 15 aa, Artificial Sequence
  chemically synthesized
NIECSVFGRCCCDNY

SEQ ID NO: 169 - protein, 15 aa, Artificial Sequence
  chemically synthesized
PACRPMFWNRSCDNI

SEQ ID NO: 170 - protein, 15 aa, Artificial Sequence
  chemically synthesized
PCRVSNMFFPYNCLD

SEQ ID NO: 171 - protein, 15 aa, Artificial Sequence
  chemically synthesized
PIMCMLLPESYCWIW

SEQ ID NO: 172 - protein, 15 aa, Artificial Sequence
  chemically synthesized
PQSCYMFASLCMPNG

SEQ ID NO: 173 - protein, 15 aa, Artificial Sequence
  chemically synthesized
PRCPQGLPLYQCSSF

SEQ ID NO: 174 - protein, 15 aa, Artificial Sequence
  chemically synthesized
PSVECLVFKRCYALP

SEQ ID NO: 175 - protein, 15 aa, Artificial Sequence
  chemically synthesized
PVCQRSATIYNCNWF

SEQ ID NO: 176 - protein, 15 aa, Artificial Sequence
  chemically synthesized
QCAAYYISSFGGCSN

SEQ ID NO: 177 - protein, 15 aa, Artificial Sequence
  chemically synthesized
QFGCFMLARDFCGTY

SEQ ID NO: 178 - protein, 15 aa, Artificial Sequence
  chemically synthesized
QMMCPYNPEHKCHQK

SEQ ID NO: 179 - protein, 15 aa, Artificial Sequence
  chemically synthesized
QRECWMFASSCNSKN

SEQ ID NO: 180 - protein, 15 aa, Artificial Sequence
  chemically synthesized
QSNMCTTYICSSFNY

SEQ ID NO: 181 - protein, 15 aa, Artificial Sequence
  chemically synthesized
QSRCHSLAPYLCSSF

SEQ ID NO: 182 - protein, 15 aa, Artificial Sequence
  chemically synthesized
RAYCSLLFADSCNNN

SEQ ID NO: 183 - protein, 15 aa, Artificial Sequence
  chemically synthesized
RCIGINQYIDSNCYN

SEQ ID NO: 184 - protein, 15 aa, Artificial Sequence
  chemically synthesized
RLSCFMFASQCALEF

SEQ ID NO: 185 - protein, 15 aa, Artificial Sequence
  chemically synthesized
RQCIILMNHRQCFFK

SEQ ID NO: 186 - protein, 15 aa, Artificial Sequence
  chemically synthesized
RSCTPYMMSSSLCNT

SEQ ID NO: 187 - protein, 15 aa, Artificial Sequence
  chemically synthesized
RYCHYWKMPYECSSF

SEQ ID NO: 188 - protein, 15 aa, Artificial Sequence
  chemically synthesized
SCVSLSWFDMLKCYE

SEQ ID NO: 189 - protein, 15 aa, Artificial Sequence
  chemically synthesized
SDNCEIWWTVCSAAM

SEQ ID NO: 190 - protein, 15 aa, Artificial Sequence
  chemically synthesized
SFCWSYLVSSGLCGV

SEQ ID NO: 191 - protein, 15 aa, Artificial Sequence
  chemically synthesized
SMCMNNYGTTIMCGN

SEQ ID NO: 192 - protein, 15 aa, Artificial Sequence
  chemically synthesized
SMVGCGWSTFCPSRG

SEQ ID NO: 193 - protein, 15 aa, Artificial Sequence
  chemically synthesized
SSLHCANGHTCPFCL

SEQ ID NO: 194 - protein, 15 aa, Artificial Sequence
  chemically synthesized
SVCSYYEESSGICSP

SEQ ID NO: 195 - protein, 15 aa, Artificial Sequence
  chemically synthesized
SWCGWYAASSGVCAL

SEQ ID NO: 196 - protein, 15 aa, Artificial Sequence
  chemically synthesized
TCISQTIDSYLNCVN

SEQ ID NO: 197 - protein, 15 aa, Artificial Sequence
  chemically synthesized
TFCNLYTKSSNICMS

SEQ ID NO: 198 - protein, 15 aa, Artificial Sequence
  chemically synthesized
TYCVFHEYLDNTCNN

SEQ ID NO: 199 - protein, 15 aa, Artificial Sequence
  chemically synthesized
VATGCPNLMLCGSWP

SEQ ID NO: 200 - protein, 15 aa, Artificial Sequence
  chemically synthesized
VEYCSLLLGNRCDYW

SEQ ID NO: 201 - protein, 15 aa, Artificial Sequence
  chemically synthesized
VGCNMYLMSAGLCVD

SEQ ID NO: 202 - protein, 15 aa, Artificial Sequence
  chemically synthesized
VLYCSWDSGTCVGSH

SEQ ID NO: 203 - protein, 15 aa, Artificial Sequence
  chemically synthesized
VMFSCYYLETCAPGV

SEQ ID NO: 204 - protein, 15 aa, Artificial Sequence
  chemically synthesized
VRIGLCPESCLVSGF

SEQ ID NO: 205 - protein, 15 aa, Artificial Sequence
  chemically synthesized
VTCTYYATSSSLCNT

SEQ ID NO: 206 - protein, 15 aa, Artificial Sequence
  chemically synthesized
VTGCILLPKAWCWGD

SEQ ID NO: 207 - protein, 15 aa, Artificial Sequence
  chemically synthesized
VWCSIYEYSSNLCSR

SEQ ID NO: 208 - protein, 15 aa, Artificial Sequence
  chemically synthesized
WMLECQYNNTCNNMT

SEQ ID NO: 209 - protein, 15 aa, Artificial Sequence
  chemically synthesized
WPCSPLEYYNNICNV

SEQ ID NO: 210 - protein, 15 aa, Artificial Sequence
  chemically synthesized
WTYDCHLNQTCPTYY

SEQ ID NO: 211 - protein, 15 aa, Artificial Sequence
  chemically synthesized
YCSINMYLIGGNCMY

SEQ ID NO: 212 - protein, 15 aa, Artificial Sequence
  chemically synthesized
YFCSLYANSAGFCGG

SEQ ID NO: 213 - protein, 15 aa, Artificial Sequence
  chemically synthesized
YVSCYMFSSSCPSTW

SEQ ID NO: 214 - protein, 13 aa, Artificial Sequence
  chemically synthesized
ISSGLLSGRSDNH

SEQ ID NO: 215 - protein, 158 aa, Artificial Sequence
  chemically synthesized
QGQSGQGAMSGCSWSAFCPYLAGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 216 - DNA, 474 bp, Artificial Sequence
  chemically synthesized
caaggccagtctggccaaggtgcgatgagtgggtgctcgtggtctgctttttgcccgtatttggcgggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 217 - protein, 158 aa, Artificial Sequence
  chemically synthesized
QGQSGQGDVNCAIWYSVCTTVPGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 218 - DNA, 474 bp, Artificial Sequence
  chemically synthesized
caaggccagtctggccaaggtgatgttaattgcgctatttggtattcggtgtgcactactgttcctggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 219 - protein, 158 aa, Artificial Sequence
  chemically synthesized
QGQSGQGLVCPLYALSSGVCMGGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 220 - DNA, 474 bp, Artificial Sequence
  chemically synthesized
caaggccagtctggccaaggtttggtttgccctttgtatgcattgagttctggggtgtgcatggggggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 221 - protein, 158 aa, Artificial Sequence
  chemically synthesized
QGQSGQGETCNQYERSSGLCFAGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 222 - DNA, 474 bp, Artificial Sequence
  chemically synthesized
caaggccagtctggccaaggtgagacttgcaatcagtatgagaggtcgagtggtttgtgctttgcgggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 223 - protein, 158 aa, Artificial Sequence
  chemically synthesized
QGQSGQGAPRTCYTYQCSSFYTGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 224 - DNA, 474 bp, Artificial Sequence
  chemically synthesized
caaggccagtctggccaaggtgcgccgcggacgtgctatacgtatcagtgctctagtttttatactggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 225 - protein, 158 aa, Artificial Sequence
  chemically synthesized
QGQSGQGGLCSWYLSSSGLCVDGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 226 - DNA, 474 bp, Artificial Sequence
  chemically synthesized
caaggccagtctggccaaggtggtctttgcagttggtatcttagtagttcgggtttgtgcgtggatggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 227 - protein, 158 aa, Artificial Sequence
  chemically synthesized
QGQSGQGAMSGCSWSAFCPYLAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 228 - DNA, 474 bp, Artificial Sequence
  chemically synthesized
caaggccagtctggccaaggtgcgatgagtgggtgctcgtggtctgctttttgcccgtatttggcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 229 - protein, 158 aa, Artificial Sequence
  chemically synthesized
QGQSGQGDVNCAIWYSVCTTVPGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 230 - DNA, 474 bp, Artificial Sequence
  chemically synthesized
caaggccagtctggccaaggtgatgttaattgcgctatttggtattcggtgtgcactactgttcctggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 231 - protein, 158 aa, Artificial Sequence
  chemically synthesized
QGQSGQGLVCPLYALSSGVCMGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 232 - DNA, 474 bp, Artificial Sequence
  chemically synthesized
caaggccagtctggccaaggtttggtttgccctttgtatgcattgagttctggggtgtgcatggggggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 233 - protein, 158 aa, Artificial Sequence
  chemically synthesized
QGQSGQGSVNCRIWSAVCAGYEGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 234 - DNA, 474 bp, Artificial Sequence
  chemically synthesized
caaggccagtctggccaaggttctgtgaattgccggatttggtcggctgtttgcgcggggtatgagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 235 - protein, 158 aa, Artificial Sequence
  chemically synthesized
QGQSGQGMLVCSLQPTAMCERVGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 236 - DNA, 474 bp, Artificial Sequence
  chemically synthesized
caaggccagtctggccaaggtatgcttgtgtgctcgttgcagcctactgcgatgtgcgagcgggtgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 237 - protein, 158 aa, Artificial Sequence
  chemically synthesized
QGQSGQGAPRCYMFASYCKSQYGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 238 - DNA, 474 bp, Artificial Sequence
  chemically synthesized
caaggccagtctggccaaggtgcgcctaggtgctatatgtttgcgtcgtattgcaagagtcagtatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 239 - protein, 158 aa, Artificial Sequence
  chemically synthesized
QGQSGQGVGPCELTPKPVCNTYGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 240 - DNA, 474 bp, Artificial Sequence
  chemically synthesized
caaggccagtctggccaaggtgtggggccttgcgagttgacgccgaagcctgtttgcaatacgtatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 241 - protein, 158 aa, Artificial Sequence
  chemically synthesized
QGQSGQGETCNQYERSSGLCFAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 242 - DNA, 474 bp, Artificial Sequence
  chemically synthesized
caaggccagtctggccaaggtgagacttgcaatcagtatgagaggtcgagtggtttgtgctttgcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 243 - protein, 158 aa, Artificial Sequence
  chemically synthesized
QGQSGQGAPRTCYTYQCSSFYTGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 244 - DNA, 474 bp, Artificial Sequence
  chemically synthesized
caaggccagtctggccaaggtgcgccgcggacgtgctatacgtatcagtgctctagtttttatactggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 245 - protein, 158 aa, Artificial Sequence
  chemically synthesized
QGQSGQGGLCSWYLSSSGLCVDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 246 - DNA, 474 bp, Artificial Sequence
  chemically synthesized
caaggccagtctggccaaggtggtctttgcagttggtatcttagtagttcgggtttgtgcgtggatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 247 - protein, 158 aa, Artificial Sequence
  chemically synthesized
QGQSGQGVPWCQLTPRVMCMWAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 248 - DNA, 474 bp, Artificial Sequence
  chemically synthesized
caaggccagtctggccaaggtgtgccttggtgccagttgacgccgcgggttatgtgcatgtgggcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 249 - protein, 158 aa, Artificial Sequence
  chemically synthesized
QGQSGQGNWLDCQFYSECSVYGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 250 - DNA, 474 bp, Artificial Sequence
  chemically synthesized
caaggccagtctggccaaggtaattggttggattgccagttttattctgagtgctctgtttatggtggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 251 - protein, 158 aa, Artificial Sequence
  chemically synthesized
QGQSGQGSCPLYVMSSFGGCWDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 252 - DNA, 474 bp, Artificial Sequence
  chemically synthesized
caaggccagtctggccaaggttcgtgccctttgtatgtgatgtctagttttggtgggtgctgggatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 253 - protein, 158 aa, Artificial Sequence
  chemically synthesized
QGQSGQGMSHCWMFSSSCDGVKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 254 - DNA, 474 bp, Artificial Sequence
  chemically synthesized
caaggccagtctggccaaggtatgagtcattgctggatgttttcgagttcttgcgatggggtgaagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 255 - protein, 158 aa, Artificial Sequence
  chemically synthesized
QGQSGQGVSYCTWLIEVTCLRGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 256 - DNA, 474 bp, Artificial Sequence
  chemically synthesized
caaggccagtctggccaaggtgtttcgtattgcacgtggttgattgaggtgacttgcctgaggggtggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 257 - protein, 158 aa, Artificial Sequence
  chemically synthesized
QGQSGQGVLCAAYALSSGICGGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 258 - DNA, 474 bp, Artificial Sequence
  chemically synthesized
caaggccagtctggccaaggtgttttgtgcgctgcttatgctttgagttcgggtatttgcggtgggggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 259 - protein, 158 aa, Artificial Sequence
  chemically synthesized
QGQSGQGTTCNLYQQSSMFCNAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 260 - DNA, 474 bp, Artificial Sequence
  chemically synthesized
caaggccagtctggccaaggtacgacttgcaatctgtatcagcagtcttctatgttttgcaatgctggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 261 - protein, 158 aa, Artificial Sequence; identical to SEQ ID NO: 237
  chemically synthesized

SEQ ID NO: 262 - DNA, 474 bp, Artificial Sequence; identical to SEQ ID NO: 238
  chemically synthesized

SEQ ID NO: 263 - protein, 158 aa, Artificial Sequence
  chemically synthesized
QGQSGQGPCDQNPYFYPYVCHAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 264 - DNA, 474 bp, Artificial Sequence
  chemically synthesized
caaggccagtctggccaaggtccttgcgatcagaatccgtatttttatccgtatgtgtgccatgcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 265 - protein, 158 aa, Artificial Sequence
  chemically synthesized
QGQSGQGSVCPMYALSSMLCGAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 266 - DNA, 474 bp, Artificial Sequence
  chemically synthesized
caaggccagtctggccaaggttctgtgtgccctatgtatgcgttgagttctatgttgtgcggtgcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 267 - protein, 158 aa, Artificial Sequence
  chemically synthesized
QGQSGQGLSVECYVFSRCSSLPGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 268 - DNA, 474 bp, Artificial Sequence
  chemically synthesized
caaggccagtctggccaaggtttgtctgtggagtgctatgtgttttcgcggtgcagtagtctgccgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 269 - protein, 157 aa, Artificial Sequence
  chemically synthesized
QGQSGQGFYCTYLVSLTCHPQGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 270 - DNA, 471 bp, Artificial Sequence
  chemically synthesized
caaggccagtctggccaaggtttttattgcacttatttggtgtctttgacttgccatccgcagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 271 - protein, 158 aa, Artificial Sequence
  chemically synthesized
QGQSGQGSMAGCQWSSFCVQRDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 272 - DNA, 474 bp, Artificial Sequence
  chemically synthesized
caaggccagtctggccaaggttctatggcgggttgccagtggagttcgttttgcgtgcagcgggatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 273 - protein, 158 aa, Artificial Sequence
  chemically synthesized
QGQSGQGIYSCYMFASRCTSDKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 274 - DNA, 474 bp, Artificial Sequence
  chemically synthesized
caaggccagtctggccaaggtatttattcgtgctatatgtttgcttcgcggtgcacgtctgataagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 275 - protein, 161 aa, Artificial Sequence
  chemically synthesized
QGQSGQGDVNCAIWYSVCTTVPGGGSSGGAVGLLAPPGGLSGRSDNHGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 276 - DNA, 579 bp, Artificial Sequence
  chemically synthesized
caaggccagtctggccaaggtcaaggccagtctggccaaggtgatgttaattgcgctatttggtattcggtgtgcactactgttcctggaggtggctcgagcggcggctctatctcttccggactgctgtccggcagatccgacaatcacggcggaggatccggaggtggctcgagcggcggcgctgtgggactgctggctcctcctggtggcctgtctggcagatctgataaccacggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 277 - protein, 161 aa, Artificial Sequence
  chemically synthesized
QGQSGQGNWLDCQFYSECSVYGGGGSSGGAVGLLAPPGGLSGRSDNHGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 278 - DNA, 558 bp, Artificial Sequence
  chemically synthesized
caaggccagtctggccaaggtaattggttggattgccagttttattctgagtgctctgtttatggtggaggtggctcgagcggcggctctatctcttccggactgctgtccggcagatccgacaatcacggcggaggatccggaggtggctcgagcggcggcgctgtgggactgctggctcctcctggtggcctgtctggcagatctgataaccacggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 279 - protein, 161 aa, Artificial Sequence
  chemically synthesized
QGQSGQGVLCAAYALSSGICGGGGGSSGGAVGLLAPPGGLSGRSDNHGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 280 - DNA, 558 bp, Artificial Sequence
  chemically synthesized
caaggccagtctggccaaggtgttttgtgcgctgcttatgctttgagttcgggtatttgcggtgggggaggtggctcgagcggcggctctatctcttccggactgctgtccggcagatccgacaatcacggcggaggatccggaggtggctcgagcggcggcgctgtgggactgctggctcctcctggtggcctgtctggcagatctgataaccacggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 281 - protein, 158 aa, Artificial Sequence
  chemically synthesized
QGQSGQGSRCSVYEVSSGLCDWGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 282 - DNA, 474 bp, Artificial Sequence
  chemically synthesized
caaggccagtctggccaaggttctcgttgctctgtgtatgaggtttcgtcggggctgtgcgattggggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 283 - protein, 158 aa, Artificial Sequence
  chemically synthesized
QGQSGQGGMCSAYAYSSKLCTIGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 284 - DNA, 474 bp, Artificial Sequence
  chemically synthesized
caaggccagtctggccaaggtgggatgtgctcggcgtatgcttattcgagtaagttgtgcactattggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 285 - protein, 158 aa, Artificial Sequence
  chemically synthesized
QGQSGQGMTTNTCNLLCQQFLTGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 286 - DNA, 474 bp, Artificial Sequence
  chemically synthesized
caaggccagtctggccaaggtatgactacgaatacttgcaatctgttgtgccagcagtttttgacgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 287 - protein, 158 aa, Artificial Sequence
  chemically synthesized
QGQSGQGFQPCLMFASSCFTSKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 288 - DNA, 474 bp, Artificial Sequence
  chemically synthesized
caaggccagtctggccaaggttttcagccgtgcctgatgtttgcgagtagttgctttactagtaagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 289 - protein, 158 aa, Artificial Sequence
  chemically synthesized
QGQSGQGALCSMYLASSGLCNKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 290 - DNA, 474 bp, Artificial Sequence
  chemically synthesized
caaggccagtctggccaaggtgcgctttgcagtatgtatcttgctagttctgggctgtgcaataagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 291 - protein, 158 aa, Artificial Sequence
  chemically synthesized
QGQSGQGEFCARDWLPYQCSSFGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 292 - DNA, 474 bp, Artificial Sequence
  chemically synthesized
caaggccagtctggccaaggtgagttttgcgctcgggattggctgccgtatcagtgctcgagttttggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 293 - protein, 158 aa, Artificial Sequence
  chemically synthesized
QGQSGQGPYICSSFPLDCQAGQGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 294 - protein, 8 aa, Artificial Sequence
  chemically synthesized
LSGRSDNH

SEQ ID NO: 295 - protein, 8 aa, Artificial Sequence
  chemically synthesized
TGRGPSWV

SEQ ID NO: 296 - protein, 8 aa, Artificial Sequence
  chemically synthesized
PLTGRSGG

SEQ ID NO: 297 - protein, 8 aa, Artificial Sequence
  chemically synthesized
TARGPSFK

SEQ ID NO: 298 - protein, 12 aa, Artificial Sequence
  chemically synthesized
NTLSGRSENHSG

SEQ ID NO: 299 - protein, 12 aa, Artificial Sequence
  chemically synthesized
NTLSGRSGNHGS

SEQ ID NO: 300 - protein, 12 aa, Artificial Sequence
  chemically synthesized
TSTSGRSANPRG

SEQ ID NO: 301 - protein, 8 aa, Artificial Sequence
  chemically synthesized
TSGRSANP

SEQ ID NO: 302 - protein, 10 aa, Artificial Sequence
  chemically synthesized
VHMPLGFLGP

SEQ ID NO: 303 - protein, 8 aa, Artificial Sequence
  chemically synthesized
AVGLLAPP

SEQ ID NO: 304 - protein, 8 aa, Artificial Sequence
  chemically synthesized
AQNLLGMV

SEQ ID NO: 305 - protein, 8 aa, Artificial Sequence
  chemically synthesized
QNQALRMA

SEQ ID NO: 306 - protein, 8 aa, Artificial Sequence
  chemically synthesized
LAAPLGLL

SEQ ID NO: 307 - protein, 8 aa, Artificial Sequence
  chemically synthesized
STFPFGMF

SEQ ID NO: 308 - protein, 8 aa, Artificial Sequence
  chemically synthesized
ISSGLLSS

SEQ ID NO: 309 - protein, 8 aa, Artificial Sequence
  chemically synthesized
PAGLWLDP

SEQ ID NO: 310 - protein, 8 aa, Artificial Sequence
  chemically synthesized
VAGRSMRP

SEQ ID NO: 311 - protein, 8 aa, Artificial Sequence
  chemically synthesized
VVPEGRRS

SEQ ID NO: 312 - protein, 8 aa, Artificial Sequence
  chemically synthesized
ILPRSPAF

SEQ ID NO: 313 - protein, 8 aa, Artificial Sequence
  chemically synthesized
MVLGRSLL

SEQ ID NO: 314 - protein, 8 aa, Artificial Sequence
  chemically synthesized
QGRAITFI

SEQ ID NO: 315 - protein, 8 aa, Artificial Sequence
  chemically synthesized
SPRSIMLA

SEQ ID NO: 316 - protein, 8 aa, Artificial Sequence
  chemically synthesized
SMLRSMPL

SEQ ID NO: 317 - protein, 16 aa, Artificial Sequence
  chemically synthesized
VIWAGGSTNYNSALMS

SEQ ID NO: 318 - protein, 18 aa, Artificial Sequence
  chemically synthesized
AVGLLAPPGGLSGRSDNH

SEQ ID NO: 319 - protein, 8 aa, Artificial Sequence
  chemically synthesized
SARGPSRW

SEQ ID NO: 320 - protein, 8 aa, Artificial Sequence
  chemically synthesized
GGWHTGRN

SEQ ID NO: 321 - protein, 8 aa, Artificial Sequence
  chemically synthesized
HTGRSGAL

SEQ ID NO: 322 - protein, 8 aa, Artificial Sequence
  chemically synthesized
AARGPAIH

SEQ ID NO: 323 - protein, 8 aa, Artificial Sequence
  chemically synthesized
RGPAFNPM

SEQ ID NO: 324 - protein, 8 aa, Artificial Sequence
  chemically synthesized
SSRGPAYL

SEQ ID NO: 325 - protein, 8 aa, Artificial Sequence
  chemically synthesized
RGPATPIM

SEQ ID NO: 326 - protein, 4 aa, Artificial Sequence
  chemically synthesized
RGPA

SEQ ID NO: 327 - protein, 10 aa, Artificial Sequence
  chemically synthesized
GGQPSGMWGW

SEQ ID NO: 328 - protein, 10 aa, Artificial Sequence
  chemically synthesized
FPRPLGITGL

SEQ ID NO: 329 - protein, 8 aa, Artificial Sequence
  chemically synthesized
SPLTGRSG

SEQ ID NO: 330 - protein, 8 aa, Artificial Sequence
  chemically synthesized
SAGFSLPA

SEQ ID NO: 331 - protein, 9 aa, Artificial Sequence
  chemically synthesized
LAPLGLQRR

SEQ ID NO: 332 - protein, 8 aa, Artificial Sequence
  chemically synthesized
SGGPLGVR

SEQ ID NO: 333 - protein, 4 aa, Artificial Sequence
  chemically synthesized
PLGL

SEQ ID NO: 334 - protein, 7 aa, Artificial Sequence
  chemically synthesized
ISSGLSS

SEQ ID NO: 335 - protein, 8 aa, Artificial Sequence
  chemically synthesized
PVGYTSSL

SEQ ID NO: 336 - protein, 8 aa, Artificial Sequence
  chemically synthesized
DWLYWPGI

SEQ ID NO: 337 - protein, 8 aa, Artificial Sequence
  chemically synthesized
LKAAPRWA

SEQ ID NO: 338 - protein, 8 aa, Artificial Sequence
  chemically synthesized
GPSHLVLT

SEQ ID NO: 339 - protein, 8 aa, Artificial Sequence
  chemically synthesized
LPGGLSPW

SEQ ID NO: 340 - protein, 8 aa, Artificial Sequence
  chemically synthesized
MGLFSEAG

SEQ ID NO: 341 - protein, 8 aa, Artificial Sequence
  chemically synthesized
SPLPLRVP

SEQ ID NO: 342 - protein, 8 aa, Artificial Sequence
  chemically synthesized
RMHLRSLG

SEQ ID NO: 343 - protein, 8 aa, Artificial Sequence
  chemically synthesized
LLAPSHRA

SEQ ID NO: 344 - protein, 7 aa, Artificial Sequence
  chemically synthesized
GPRSFGL

SEQ ID NO: 345 - protein, 6 aa, Artificial Sequence
  chemically synthesized
GPRSFG

SEQ ID NO: 346 - protein, 22 aa, Artificial Sequence
  chemically synthesized
ISSGLLSSGGSGGSLSGRSDNH

SEQ ID NO: 347 - protein, 22 aa, Artificial Sequence
  chemically synthesized
AVGLLAPPGGTSTSGRSANPRG

SEQ ID NO: 348 - protein, 22 aa, Artificial Sequence
  chemically synthesized
TSTSGRSANPRGGGAVGLLAPP

SEQ ID NO: 349 - protein, 24 aa, Artificial Sequence
  chemically synthesized
VHMPLGFLGPGGTSTSGRSANPRG

SEQ ID NO: 350 - protein, 24 aa, Artificial Sequence
  chemically synthesized
TSTSGRSANPRGGGVHMPLGFLGP

SEQ ID NO: 351 - protein, 18 aa, Artificial Sequence
  chemically synthesized
LSGRSDNHGGAVGLLAPP

SEQ ID NO: 352 - protein, 20 aa, Artificial Sequence
  chemically synthesized
VHMPLGFLGPGGLSGRSDNH

SEQ ID NO: 353 - protein, 20 aa, Artificial Sequence
  chemically synthesized
LSGRSDNHGGVHMPLGFLGP

SEQ ID NO: 354 - protein, 22 aa, Artificial Sequence
  chemically synthesized
LSGRSDNHGGSGGSISSGLLSS

SEQ ID NO: 355 - protein, 22 aa, Artificial Sequence
  chemically synthesized
LSGRSGNHGGSGGSISSGLLSS

SEQ ID NO: 356 - protein, 22 aa, Artificial Sequence
  chemically synthesized
ISSGLLSSGGSGGSLSGRSGNH

SEQ ID NO: 357 - protein, 22 aa, Artificial Sequence
  chemically synthesized
LSGRSDNHGGSGGSQNQALRMA

SEQ ID NO: 358 - protein, 22 aa, Artificial Sequence
  chemically synthesized
QNQALRMAGGSGGSLSGRSDNH

SEQ ID NO: 359 - protein, 22 aa, Artificial Sequence
  chemically synthesized
LSGRSGNHGGSGGSQNQALRMA

SEQ ID NO: 360 - protein, 22 aa, Artificial Sequence
  chemically synthesized
QNQALRMAGGSGGSLSGRSGNH

SEQ ID NO: 361 - protein, 13 aa, Artificial Sequence
  chemically synthesized
ISSGLLSGRSGNH

SEQ ID NO: 362 - protein, 7 aa, Artificial Sequence
  chemically synthesized
QGQSGQG

SEQ ID NO: 363 - protein, 5 aa, Artificial Sequence
  chemically synthesized
GSGGS

SEQ ID NO: 364 - protein, 4 aa, Artificial Sequence
  chemically synthesized
GGGS

SEQ ID NO: 365 - protein, 4 aa, Artificial Sequence
  chemically synthesized
GGSG

SEQ ID NO: 366 - protein, 5 aa, Artificial Sequence
  chemically synthesized
GGSGG

SEQ ID NO: 367 - protein, 5 aa, Artificial Sequence
  chemically synthesized
GSGSG

SEQ ID NO: 368 - protein, 5 aa, Artificial Sequence
  chemically synthesized
GSGGG

SEQ ID NO: 369 - protein, 5 aa, Artificial Sequence
  chemically synthesized
GGGSG

SEQ ID NO: 370 - protein, 5 aa, Artificial Sequence
  chemically synthesized
GSSSG

SEQ ID NO: 371 - protein, 13 aa, Artificial Sequence
  chemically synthesized
GSSGGSGGSGGSG

SEQ ID NO: 372 - protein, 11 aa, Artificial Sequence
  chemically synthesized
GSSGGSGGSGG

SEQ ID NO: 373 - protein, 12 aa, Artificial Sequence
  chemically synthesized
GSSGGSGGSGGS

SEQ ID NO: 374 - protein, 16 aa, Artificial Sequence
  chemically synthesized
GSSGGSGGSGGSGGGS

SEQ ID NO: 375 - protein, 10 aa, Artificial Sequence
  chemically synthesized
GSSGGSGGSG

SEQ ID NO: 376 - protein, 11 aa, Artificial Sequence
  chemically synthesized
GSSGGSGGSGS

SEQ ID NO: 377 - protein, 4 aa, Artificial Sequence
  chemically synthesized
GGGS

SEQ ID NO: 378 - protein, 5 aa, Artificial Sequence
  chemically synthesized
GSSGT

SEQ ID NO: 379 - protein, 4 aa, Artificial Sequence
  chemically synthesized
GSSG

SEQ ID NO: 380 - protein, 281 aa, Artificial Sequence
  chemically synthesized
  MISC_FEATURE (16)..(35): Any one or all of amino acids 16 to 35 may be present or absent
  MISC_FEATURE (44)..(63): Any one or all of amino acids 44 to 63 may be present or absent
AMSGCSWSAFCPYLAXXXXXXXXXXXXXXXXXXXXLSGRSDNHXXXXXXXXXXXXXXXXXXXXDIQLTQSPSSLSASVGDRVTITCRASESVDNYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 381 - protein, 329 aa, Artificial Sequence
  chemically synthesized
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 382 - protein, 329 aa, Artificial Sequence
  chemically synthesized
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 383 - protein, 326 aa, Artificial Sequence
  chemically synthesized
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 384 - protein, 15 aa, Artificial Sequence
  chemically synthesized
DYTYCRWVNWCLSGV

SEQ ID NO: 385 - protein, 15 aa, Artificial Sequence
  chemically synthesized
ILCPEDPWGHKCKLP

SEQ ID NO: 386 - protein, 15 aa, Artificial Sequence
  chemically synthesized
TNIWSCQTYCDHKHK

SEQ ID NO: 387 - protein, 15 aa, Artificial Sequence
  chemically synthesized
SDHKCKLQNCMNTKV

SEQ ID NO: 388 - protein, 15 aa, Artificial Sequence
  chemically synthesized
PGNCHPMQKEMCQFI

SEQ ID NO: 389 - protein, 15 aa, Artificial Sequence
  chemically synthesized
VEHLCYTHNKCKHPD

SEQ ID NO: 390 - protein, 15 aa, Artificial Sequence
  chemically synthesized
TIPRCGQHPKCKDTL

SEQ ID NO: 391 - protein, 15 aa, Artificial Sequence
  chemically synthesized
ACRICQDHPKTKWNS

SEQ ID NO: 392 - protein, 15 aa, Artificial Sequence
  chemically synthesized
LIQCTGNLDHKCKHY

SEQ ID NO: 393 - protein, 15 aa, Artificial Sequence
  chemically synthesized
IPCHHSADHKHKCTS

SEQ ID NO: 394 - protein, 15 aa, Artificial Sequence
  chemically synthesized
SRQICADYNCHNKYK

SEQ ID NO: 395 - protein, 15 aa, Artificial Sequence
  chemically synthesized
QPCNPQIDHKIKCIY

SEQ ID NO: 396 - protein, 15 aa, Artificial Sequence
  chemically synthesized
HYTICMTHNKCKDMA

SEQ ID NO: 397 - protein, 15 aa, Artificial Sequence
  chemically synthesized
ANSCLAVEHKCKHNY

SEQ ID NO: 398 - protein, 15 aa, Artificial Sequence
  chemically synthesized
AALHCTEHKCKNHIK

SEQ ID NO: 399 - protein, 15 aa, Artificial Sequence
  chemically synthesized
APCIINTVDWKSCEI

SEQ ID NO: 400 - protein, 15 aa, Artificial Sequence
  chemically synthesized
ATNWCTHKQKCKQDM

SEQ ID NO: 401 - protein, 15 aa, Artificial Sequence
  chemically synthesized
DCYNEHKLKTRVCNN

SEQ ID NO: 402 - protein, 15 aa, Artificial Sequence
  chemically synthesized
DEMQCSHKQKCTNSK

SEQ ID NO: 403 - protein, 15 aa, Artificial Sequence
  chemically synthesized
DVGICSQHNKCKPTK

SEQ ID NO: 404 - protein, 15 aa, Artificial Sequence
  chemically synthesized
EKYCSSDDHKCKITL

SEQ ID NO: 405 - protein, 15 aa, Artificial Sequence
  chemically synthesized
ELECSHNKVKNCIQI

SEQ ID NO: 406 - protein, 15 aa, Artificial Sequence
  chemically synthesized
ELHPCNTHKCKPIVN

SEQ ID NO: 407 - protein, 15 aa, Artificial Sequence
  chemically synthesized
EVGSCNHPKCKSNNY

SEQ ID NO: 408 - protein, 15 aa, Artificial Sequence
  chemically synthesized
EYSPSLAHPKLKDNA

SEQ ID NO: 409 - protein, 15 aa, Artificial Sequence
  chemically synthesized
FESLHPKGKHPEDLG

SEQ ID NO: 410 - protein, 15 aa, Artificial Sequence
  chemically synthesized
FPLCVRADRVCGDAQ

SEQ ID NO: 411 - protein, 15 aa, Artificial Sequence
  chemically synthesized
FQAPPASHNKLKPSL

SEQ ID NO: 412 - protein, 15 aa, Artificial Sequence
  chemically synthesized
GAIDSCHHKCKSPHY

SEQ ID NO: 413 - protein, 15 aa, Artificial Sequence
  chemically synthesized
GKIYTCEHNCTFGYS

SEQ ID NO: 414 - protein, 15 aa, Artificial Sequence
  chemically synthesized
HCTVNNHSSDHKCKI

SEQ ID NO: 415 - protein, 15 aa, Artificial Sequence
  chemically synthesized
HGTQCTHNKCKPILS

SEQ ID NO: 416 - protein, 15 aa, Artificial Sequence
  chemically synthesized
HIGWCLHPKCKTTTT

SEQ ID NO: 417 - protein, 15 aa, Artificial Sequence
  chemically synthesized
HLRTCIQKWCEHKMK

SEQ ID NO: 418 - protein, 15 aa, Artificial Sequence
  chemically synthesized
HTDCTMMSNHKCKIN

SEQ ID NO: 419 - protein, 15 aa, Artificial Sequence
  chemically synthesized
IRQQCTALACLLKVH

SEQ ID NO: 420 - protein, 15 aa, Artificial Sequence
  chemically synthesized
KGCSTHKMRAYCNQM

SEQ ID NO: 421 - protein, 15 aa, Artificial Sequence
  chemically synthesized
KMFTPCKIWCNNSYN

SEQ ID NO: 422 - protein, 15 aa, Artificial Sequence
  chemically synthesized
KTMCSGHKQKCNNSS

SEQ ID NO: 423 - protein, 15 aa, Artificial Sequence
  chemically synthesized
LACHSASLVDHKCKL

SEQ ID NO: 424 - protein, 15 aa, Artificial Sequence
  chemically synthesized
LCNVSMDHKHKPCYL

SEQ ID NO: 425 - protein, 15 aa, Artificial Sequence
  chemically synthesized
LGLNCFSEHKCKEHM

SEQ ID NO: 426 - protein, 15 aa, Artificial Sequence
  chemically synthesized
LGTCTHKHKNCNYTL

SEQ ID NO: 427 - protein, 15 aa, Artificial Sequence
  chemically synthesized
LHEGCTTHNKCKPIA

SEQ ID NO: 428 - protein, 15 aa, Artificial Sequence
  chemically synthesized
LKRSCTGHWTCYTNW

SEQ ID NO: 429 - protein, 15 aa, Artificial Sequence
  chemically synthesized
LQRCTHKEKYCHAIH

SEQ ID NO: 430 - protein, 15 aa, Artificial Sequence
  chemically synthesized
LSHCYDHKRKCSYIV

SEQ ID NO: 431 - protein, 15 aa, Artificial Sequence
  chemically synthesized
LSKCHNKEKNCSNNN

SEQ ID NO: 432 - protein, 15 aa, Artificial Sequence
  chemically synthesized
MDTCEMHKQKCRPSF

SEQ ID NO: 433 - protein, 15 aa, Artificial Sequence
  chemically synthesized
MHNECLTHKCKVPIT

SEQ ID NO: 434 - protein, 15 aa, Artificial Sequence
  chemically synthesized
MLTLCNTNACHKEKN

SEQ ID NO: 435 - protein, 15 aa, Artificial Sequence
  chemically synthesized
MRPCLNNLEHKCKHY

SEQ ID NO: 436 - protein, 15 aa, Artificial Sequence
  chemically synthesized
MSRCPTHKMKCSLNI

SEQ ID NO: 437 - protein, 15 aa, Artificial Sequence
  chemically synthesized
MWICQEHKLKCMTDT

SEQ ID NO: 438 - protein, 15 aa, Artificial Sequence
  chemically synthesized
MYYCKRRSAFYCTLN

SEQ ID NO: 439 - protein, 15 aa, Artificial Sequence
  chemically synthesized
NDCQHDKQMHKCKMH

SEQ ID NO: 440 - protein, 15 aa, Artificial Sequence
  chemically synthesized
NFGPCPMLLGCFGFR

SEQ ID NO: 441 - protein, 15 aa, Artificial Sequence
  chemically synthesized
NHTDCSHPKCKSHDS

SEQ ID NO: 442 - protein, 15 aa, Artificial Sequence
  chemically synthesized
NLNCPHKQKNCDKYH

SEQ ID NO: 443 - protein, 15 aa, Artificial Sequence
  chemically synthesized
NPQCTPIDHKCKTHH

SEQ ID NO: 444 - protein, 15 aa, Artificial Sequence
  chemically synthesized
NTTSCTHPKCKHQGK

SEQ ID NO: 445 - protein, 15 aa, Artificial Sequence
  chemically synthesized
NVGGCDNYGCHKLKN

SEQ ID NO: 446 - protein, 15 aa, Artificial Sequence
  chemically synthesized
PCSPGNLTWDHKCKY

SEQ ID NO: 447 - protein, 15 aa, Artificial Sequence
  chemically synthesized
PFTKCHGFNKCKEHT

SEQ ID NO: 448 - protein, 15 aa, Artificial Sequence
  chemically synthesized
PGDKCTHKEKCYYNN

SEQ ID NO: 449 - protein, 15 aa, Artificial Sequence
  chemically synthesized
PNICNLDHKRKCRIN

SEQ ID NO: 450 - protein, 15 aa, Artificial Sequence
  chemically synthesized
PQLACKHPKCKDAGN

SEQ ID NO: 451 - protein, 15 aa, Artificial Sequence
  chemically synthesized
PSCTMWTHGGVCKHA

SEQ ID NO: 452 - protein, 15 aa, Artificial Sequence
  chemically synthesized
PSHRHPLAKPGFRVE

SEQ ID NO: 453 - protein, 15 aa, Artificial Sequence
  chemically synthesized
PTCFKTHNKSKCNRV

SEQ ID NO: 454 - protein, 15 aa, Artificial Sequence
  chemically synthesized
PTPVCHHNFHCFGYD

SEQ ID NO: 455 - protein, 15 aa, Artificial Sequence
  chemically synthesized
QATCQWKKRSKCHNK

SEQ ID NO: 456 - protein, 15 aa, Artificial Sequence
  chemically synthesized
QHSWCQHKAKCNYGN

SEQ ID NO: 457 - protein, 15 aa, Artificial Sequence
  chemically synthesized
QNCSPTYTTHKCKLT

SEQ ID NO: 458 - protein, 15 aa, Artificial Sequence
  chemically synthesized
QSSNCEHKRKCSSIS

SEQ ID NO: 459 - protein, 15 aa, Artificial Sequence
  chemically synthesized
RPCLLGLVPDHKCKL

SEQ ID NO: 460 - protein, 15 aa, Artificial Sequence
  chemically synthesized
RRSCMRSINTCKQKY

SEQ ID NO: 461 - protein, 15 aa, Artificial Sequence
  chemically synthesized
RSSCPTVTPQNCENQ

SEQ ID NO: 462 - protein, 15 aa, Artificial Sequence
  chemically synthesized
RTMCLDLNHKCKPSN

SEQ ID NO: 463 - protein, 15 aa, Artificial Sequence
  chemically synthesized
RTYWCTNHNKCKHNM

SEQ ID NO: 464 - protein, 15 aa, Artificial Sequence
  chemically synthesized
RVENCEHNQYCHKWK

SEQ ID NO: 465 - protein, 15 aa, Artificial Sequence
  chemically synthesized
SCHEDDHKNKNICSL

SEQ ID NO: 466 - protein, 15 aa, Artificial Sequence
  chemically synthesized
SDTCVMNHPKCKRDN

SEQ ID NO: 467 - protein, 15 aa, Artificial Sequence
  chemically synthesized
SSTCFHPNQKECMTK

SEQ ID NO: 468 - protein, 15 aa, Artificial Sequence
  chemically synthesized
SSYCGGITMRCRRAM

SEQ ID NO: 469 - protein, 15 aa, Artificial Sequence
  chemically synthesized
STGYCTYVNWCNYTN

SEQ ID NO: 470 - protein, 15 aa, Artificial Sequence
  chemically synthesized
THKCKLHLQVCTQTT

SEQ ID NO: 471 - protein, 15 aa, Artificial Sequence
  chemically synthesized
TMNCTHPKQKCQHTN

SEQ ID NO: 472 - protein, 15 aa, Artificial Sequence
  chemically synthesized
TNVLCESHNCDHKNK

SEQ ID NO: 473 - protein, 15 aa, Artificial Sequence
  chemically synthesized
TQHAASLGVEHKSKI

SEQ ID NO: 474 - protein, 15 aa, Artificial Sequence
  chemically synthesized
TQLPCFDDHKCKNTN

SEQ ID NO: 475 - protein, 15 aa, Artificial Sequence
  chemically synthesized
TSDSCMRQKCEHKEK

SEQ ID NO: 476 - protein, 15 aa, Artificial Sequence
  chemically synthesized
TTCDDHKYKHKCAQL

SEQ ID NO: 477 - protein, 15 aa, Artificial Sequence
  chemically synthesized
TTCGAHKEKQHCIYT

SEQ ID NO: 478 - protein, 15 aa, Artificial Sequence
  chemically synthesized
TTYCAYWHNKCKFET

SEQ ID NO: 479 - protein, 15 aa, Artificial Sequence
  chemically synthesized
VGPTCGHAKCKQSEV

SEQ ID NO: 480 - protein, 15 aa, Artificial Sequence
  chemically synthesized
VSHPCNTHKCKTNIV

SEQ ID NO: 481 - protein, 15 aa, Artificial Sequence
  chemically synthesized
WDCRNTSHPKLKCHN

SEQ ID NO: 482 - protein, 15 aa, Artificial Sequence
  chemically synthesized
WSPCNSDHKRKCNNG

SEQ ID NO: 483 - protein, 15 aa, Artificial Sequence
  chemically synthesized
YANMSCEYDCHKMKY

SEQ ID NO: 484 - protein, 15 aa, Artificial Sequence
  chemically synthesized
YANPCTHKEKCHFKN

SEQ ID NO: 485 - protein, 15 aa, Artificial Sequence
  chemically synthesized
YDCSPSWTHPKCKHK

SEQ ID NO: 486 - protein, 15 aa, Artificial Sequence
  chemically synthesized
YGWTCTTHPKCKTTN

SEQ ID NO: 487 - protein, 15 aa, Artificial Sequence
  chemically synthesized
YQKCHPKAKDCGNNT

SEQ ID NO: 488 - protein, 15 aa, Artificial Sequence
  chemically synthesized
YWECPNMEHNKCKNN

SEQ ID NO: 489 - protein, 15 aa, Artificial Sequence
  chemically synthesized
PMGNRYCVLDHPKLK

SEQ ID NO: 490 - protein, 15 aa, Artificial Sequence
  chemically synthesized
GHKSCCQKHCEYTQT

SEQ ID NO: 491 - protein, 15 aa, Artificial Sequence
  chemically synthesized
LYLEMCSCCCWESIT

SEQ ID NO: 492 - protein, 15 aa, Artificial Sequence
  chemically synthesized
ACQAQHCYKTYACKP

SEQ ID NO: 493 - protein, 15 aa, Artificial Sequence
  chemically synthesized
CCYTCSVHPKCKNQL

SEQ ID NO: 494 - protein, 15 aa, Artificial Sequence
  chemically synthesized
CKHRCSHKEKCPANH

SEQ ID NO: 495 - protein, 15 aa, Artificial Sequence
  chemically synthesized
CHVLFCLMQCCRWSL

SEQ ID NO: 496 - protein, 15 aa, Artificial Sequence
  chemically synthesized
LNSSLVFDHPKAKPN

SEQ ID NO: 497 - protein, 15 aa, Artificial Sequence
  chemically synthesized
MCLLCRSKFGCKVKG

SEQ ID NO: 498 - protein, 15 aa, Artificial Sequence
  chemically synthesized
IICNDHKCKQNQCNN

SEQ ID NO: 499 - protein, 15 aa, Artificial Sequence
  chemically synthesized
IRCSLRDSLCGCERM

SEQ ID NO: 500 - protein, 15 aa, Artificial Sequence
  chemically synthesized
TSCQPPKHKCTCNHG

SEQ ID NO: 501 - protein, 15 aa, Artificial Sequence
  chemically synthesized
TQCPHRCVKPNCWLH

SEQ ID NO: 502 - protein, 15 aa, Artificial Sequence
  chemically synthesized
KCCETKRNHKHCTYK

SEQ ID NO: 503 - protein, 15 aa, Artificial Sequence
  chemically synthesized
LPHCCHKAKHCNHTS

SEQ ID NO: 504 - protein, 15 aa, Artificial Sequence
  chemically synthesized
PAMCAAIHEKCCIKV

SEQ ID NO: 505 - protein, 15 aa, Artificial Sequence
  chemically synthesized
PRSCGNQLCPCHYYK

SEQ ID NO: 506 - protein, 15 aa, Artificial Sequence
  chemically synthesized
TNKCSCNHNMKCINY

SEQ ID NO: 507 - protein, 15 aa, Artificial Sequence
  chemically synthesized
VETCCQHNKCKYPFI

SEQ ID NO: 508 - protein, 15 aa, Artificial Sequence
  chemically synthesized
IFCCSNHEDHKCKTN

SEQ ID NO: 509 - protein, 15 aa, Artificial Sequence
  chemically synthesized
VCRLICPLTCVIGVG

SEQ ID NO: 510 - protein, 15 aa, Artificial Sequence
  chemically synthesized
FHGCCSVYSCLTNPG

SEQ ID NO: 511 - protein, 15 aa, Artificial Sequence
  chemically synthesized
ALACHPKQKPLEGQL

SEQ ID NO: 512 - protein, 15 aa, Artificial Sequence
  chemically synthesized
SIICCATSSCPLKHL

SEQ ID NO: 513 - protein, 15 aa, Artificial Sequence
  chemically synthesized
APCCRPHKEKPIDSR

SEQ ID NO: 514 - protein, 15 aa, Artificial Sequence
  chemically synthesized
WELCCPSADCRVAMG

SEQ ID NO: 515 - protein, 156 aa, Artificial Sequence
  chemically synthesized
QGQSGQGDYTYCRWVNWCLSGVGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 516 - DNA, 467 bp, Artificial Sequence
  chemically synthesized
caaggccagtctggccaaggtgattatacgtattgccgttgggttaattggtgcttgtctggggtgggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtcct

SEQ ID NO: 517 - protein, 156 aa, Artificial Sequence
  chemically synthesized
QGQSGQGILCPEDPWGHKCKLPGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 518 - DNA, 468 bp, Artificial Sequence
  chemically synthesized
caaggccagtctggccaaggtattctgtgcccggaggatccgtgggggcataagtgcaagctgcctggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 519 - protein, 156 aa, Artificial Sequence
  chemically synthesized
QGQSGQGTNIWSCQTYCDHKHKGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 520 - DNA, 468 bp, Artificial Sequence
  chemically synthesized
caaggccagtctggccaaggtacgaatatttggagttgccagacttattgcgatcataagcataagggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 521 - protein, 156 aa, Artificial Sequence
  chemically synthesized
QGQSGQGSDHKCKLQNCMNTKVGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 522 - DNA, 468 bp, Artificial Sequence
  chemically synthesized
caaggccagtctggccaaggtagtgatcataagtgcaagcttcagaattgcatgaatactaaggttggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 523 - protein, 156 aa, Artificial Sequence
  chemically synthesized
QGQSGQGPGNCHPMQKEMCQFIGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 524 - DNA, 468 bp, Artificial Sequence
  chemically synthesized
caaggccagtctggccaaggtcctggtaattgccatcctatgcagaaggagatgtgccagtttattggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 525 - protein, 156 aa, Artificial Sequence
  chemically synthesized
QGQSGQGVEHLCYTHNKCKHPDGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 526 - DNA, 468 bp, Artificial Sequence
  chemically synthesized
caaggccagtctggccaaggtgttgagcatttgtgctatacgcataataagtgcaagcatcctgatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 527 - protein, 156 aa, Artificial Sequence
  chemically synthesized
QGQSGQGTIPRCGQHPKCKDTLGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 528 - DNA, 468 bp, Artificial Sequence
  chemically synthesized
caaggccagtctggccaaggtactattccgaggtgcggtcagcatccgaagtgcaaggatactttgggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 529 - protein, 156 aa, Artificial Sequence
  chemically synthesized
QGQSGQGACRICQDHPKTKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 530 - DNA, 468 bp, Artificial Sequence
  chemically synthesized
caaggccagtctggccaaggtgcgtgccgtatttgtcaggatcatcctaagacgaagtggaattctggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 531 - protein, 156 aa, Artificial Sequence
  chemically synthesized
QGQSGQGLIQCTGNLDHKCKHYGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 532 - DNA, 467 bp, Artificial Sequence
  chemically synthesized
caaggccagtctggccaaggtcttattcagtgcactggtaatcttgatcataagtgcaagcattatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtcct

SEQ ID NO: 533 - protein, 156 aa, Artificial Sequence
  chemically synthesized
QGQSGQGIPCHHSADHKHKCTSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 534 - DNA, 468 bp, Artificial Sequence
  chemically synthesized
caaggccagtctggccaaggtattccttgccatcatagtgctgatcataagcataagtgcacgagtggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 535 - protein, 156 aa, Artificial Sequence
  chemically synthesized
QGQSGQGSRQICADYNCHNKYKGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 536 - DNA, 468 bp, Artificial Sequence
  chemically synthesized
caaggccagtctggccaaggttcgcggcagatttgcgctgattataattgccataataagtataagggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 537 - protein, 156 aa, Artificial Sequence
  chemically synthesized
QGQSGQGQPCNPQIDHKIKCIYGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 538 - DNA, 468 bp, Artificial Sequence
  chemically synthesized
caaggccagtctggccaaggtcagccttgcaatccgcagattgatcataagattaagtgcatttatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 539 - protein, 156 aa, Artificial Sequence
  chemically synthesized
QGQSGQGHYTICMTHNKCKDMAGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 540 - DNA, 468 bp, Artificial Sequence
  chemically synthesized
caaggccagtctggccaaggtcattatactatttgcatgacgcataataagtgcaaggatatggcgggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 541 - protein, 156 aa, Artificial Sequence
  chemically synthesized
QGQSGQGANSCLAVEHKCKHNYGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 542 - DNA, 468 bp, Artificial Sequence
  chemically synthesized
caaggccagtctggccaaggtgctaatagttgccttgctgttgagcataagtgcaagcataattatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 543 - protein, 214 aa, Artificial Sequence
  chemically synthesized
YELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 544 - DNA, 642 bp, Artificial Sequence
  chemically synthesized
tatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtcctaggtggacccaagtcttctcccaaagtcacagtgtttccaccttcacctgaggagctccggacaaacaaagccacactggtgtgtctggttaatgacttctacccgggttctgcaacagtgacctggaaggcaaatggagcaactatcaatgatggggtgaagactacaaagccttccaaacagggccaaaactacatgaccagcagctacctaagtttgacagcagaccagtggaaatctcacaacagggtttcctgccaagttacccatgaaggggaaactgtggagaagagtttgtcccctgcagaatgtctt

SEQ ID NO: 545 - DNA, 642 bp, Artificial Sequence
  chemically synthesized
tacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 546 - protein, 451 aa, Artificial Sequence
  chemically synthesized
EVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 547 - DNA, 1353 bp, Artificial Sequence
  chemically synthesized
gaggtgcggcttctggagtctggtggaggattagtgaagcctgaggggtcactgaaactctcctgtgtggcctctggattcaccttcagtgactatttcatgagctgggtccgccaggctccagggaaggggctggagtgggttgctcacatatacacgaaaagttataattatgcaacttattactcgggttcggtgaaaggcagattcaccatctccagagatgattcccgaagcatggtctacctgcaaatgaacaacctgagaactgaggacacggccacttattactgtacaagagatggaagcggatatccctctctggatttctggggtcaagggacccaagtcactgtctcctcagctaaaacaacagccccatcggtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 548 - protein, 10 aa, Artificial Sequence
  chemically synthesized
QDHPKTKWNS

SEQ ID NO: 549 - protein, 15 aa, Artificial Sequence
  chemically synthesized
ACRICQDHPATKWNS

SEQ ID NO: 550 - protein, 15 aa, Artificial Sequence
  chemically synthesized
ACRICQDHPKTAWNS

SEQ ID NO: 551 - protein, 15 aa, Artificial Sequence
  chemically synthesized
ACRICQDAPKTKWNS

SEQ ID NO: 552 - protein, 15 aa, Artificial Sequence
  chemically synthesized
ACRICQDHAKTKWNS

SEQ ID NO: 553 - protein, 9 aa, Artificial Sequence
  chemically synthesized
DHPATKWNS

SEQ ID NO: 554 - protein, 9 aa, Artificial Sequence
  chemically synthesized
DHPKTAWNS

SEQ ID NO: 555 - protein, 9 aa, Artificial Sequence
  chemically synthesized
DAPKTKWNS

SEQ ID NO: 556 - protein, 9 aa, Artificial Sequence
  chemically synthesized
DAPATKWNS

SEQ ID NO: 557 - protein, 9 aa, Artificial Sequence
  chemically synthesized
ACRICQDHP

SEQ ID NO: 558 - protein, 8 aa, Artificial Sequence
  chemically synthesized
HPQSKDTL

SEQ ID NO: 559 - protein, 8 aa, Artificial Sequence
  chemically synthesized
HPKSQDTL

SEQ ID NO: 560 - protein, 15 aa, Artificial Sequence
  chemically synthesized
TIPRCGQHPLCLDTL

SEQ ID NO: 561 - protein, 8 aa, Artificial Sequence
  chemically synthesized
HPLSLDTL

SEQ ID NO: 562 - protein, 8 aa, Artificial Sequence
  chemically synthesized
HPASKDTL

SEQ ID NO: 563 - protein, 8 aa, Artificial Sequence
  chemically synthesized
HPKSADTL

SEQ ID NO: 564 - protein, 15 aa, Artificial Sequence
  chemically synthesized
PGNCHPLQKELCQFI

SEQ ID NO: 565 - protein, 11 aa, Artificial Sequence
  chemically synthesized
HPLQKELAQFI

SEQ ID NO: 566 - protein, 11 aa, Artificial Sequence
  chemically synthesized
HPLALELAQFI

SEQ ID NO: 567 - protein, 15 aa, Artificial Sequence
  chemically synthesized
PGNCHPLQLELCQFI

SEQ ID NO: 568 - protein, 15 aa, Artificial Sequence
  chemically synthesized
TNIWSCQTYCDHAHA

SEQ ID NO: 569 - protein, 15 aa, Artificial Sequence
  chemically synthesized
TNIWSCQTYCDHAHL

SEQ ID NO: 570 - protein, 15 aa, Artificial Sequence
  chemically synthesized
TNIWSCQTYCDHLHA

SEQ ID NO: 571 - protein, 15 aa, Artificial Sequence
  chemically synthesized
TNIWSCQTYCDHKHA

SEQ ID NO: 572 - protein, 152 aa, Artificial Sequence
  chemically synthesized
QGQSGQGHPLQKELAQFIGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 573 - DNA, 771 bp, Artificial Sequence
  chemically synthesized
caaggccagtctggccaaggtcatcctctgcagaaggagctggcccagtttattggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 574 - protein, 149 aa, Artificial Sequence
  chemically synthesized
QGQSGQGHPQSKDTLGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 575 - DNA, 762 bp, Artificial Sequence
  chemically synthesized
caaggccagtctggccaaggtcatccgcagtctaaggatactttgggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 576 - protein, 149 aa, Artificial Sequence
  chemically synthesized
QGQSGQGHPASKDTLGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 577 - DNA, 762 bp, Artificial Sequence
  chemically synthesized
caaggccagtctggccaaggtcatccggcgtctaaggatactttgggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 578 - protein, 156 aa, Artificial Sequence
  chemically synthesized
QGQSGQGACRICQDHPATKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 579 - DNA, 782 bp, Artificial Sequence
  chemically synthesized
caaggccagtctggccaaggtgcgtgccgtatttgtcaggatcatcctgcgacgaagtggaattctggaggtggctcgagcggcggctctatctcttccggactgctgtccggcagatccgacaatcacggcggaggctctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 580 - protein, 150 aa, Artificial Sequence
  chemically synthesized
QGQSGQGDAPKTKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 581 - DNA, 765 bp, Artificial Sequence
  chemically synthesized
caaggccagtctggccaaggtgatgctcctaagacgaagtggaattctggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 582 - protein, 150 aa, Artificial Sequence
  chemically synthesized
QGQSGQGDAPATKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 583 - DNA, 765 bp, Artificial Sequence
  chemically synthesized
caaggccagtctggccaaggtgatgctcctgcgacgaagtggaattctggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 584 - DNA, 474 bp, Artificial Sequence
  chemically synthesized
caaggccagtctggccaaggtccttatatttgctctagttttccgttggattgccaggcgggtcagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 585 - protein, 273 aa, Artificial Sequence
  chemically synthesized
GGGSGGGGSGSGGGSGGGGSGGGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRSGGSTITSYNVYYTKLSSSGTQVQLVQTGGGVVQPGRSLRLSCAASGSTFSSYAMSWVRQAPGKGLEWVSAISGSGGSTYYADSVKGRFTISRDNSKNTLYLQMNSLRAEDTAVYYCATNSLYWYFDLWGRGTLVTVSSAS

SEQ ID NO: 586 - protein, 264 aa, Artificial Sequence
  chemically synthesized
GGGSGGGGSGSGGGSGGGGSGGGQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 587 - protein, 8 aa, Artificial Sequence
  chemically synthesized
PRFKIIGG

SEQ ID NO: 588 - protein, 8 aa, Artificial Sequence
  chemically synthesized
PRFRIIGG

SEQ ID NO: 589 - protein, 9 aa, Artificial Sequence
  chemically synthesized
SSRHRRALD

SEQ ID NO: 590 - protein, 14 aa, Artificial Sequence
  chemically synthesized
RKSSIIIRMRDVVL

SEQ ID NO: 591 - protein, 15 aa, Artificial Sequence
  chemically synthesized
SSSFDKGKYKKGDDA

SEQ ID NO: 592 - protein, 15 aa, Artificial Sequence
  chemically synthesized
SSSFDKGKYKRGDDA

SEQ ID NO: 593 - protein, 4 aa, Artificial Sequence
  chemically synthesized
IEGR

SEQ ID NO: 594 - protein, 4 aa, Artificial Sequence
  chemically synthesized
IDGR

SEQ ID NO: 595 - protein, 7 aa, Artificial Sequence
  chemically synthesized
GGSIDGR

SEQ ID NO: 596 - protein, 6 aa, Artificial Sequence
  chemically synthesized
PLGLWA

SEQ ID NO: 597 - protein, 8 aa, Artificial Sequence
  chemically synthesized
GPQGIAGQ

SEQ ID NO: 598 - protein, 8 aa, Artificial Sequence
  chemically synthesized
GPQGLLGA

SEQ ID NO: 599 - protein, 5 aa, Artificial Sequence
  chemically synthesized
GIAGQ

SEQ ID NO: 600 - protein, 8 aa, Artificial Sequence
  chemically synthesized
GPLGIAGI

SEQ ID NO: 601 - protein, 8 aa, Artificial Sequence
  chemically synthesized
GPEGLRVG

SEQ ID NO: 602 - protein, 8 aa, Artificial Sequence
  chemically synthesized
YGAGLGVV

SEQ ID NO: 603 - protein, 8 aa, Artificial Sequence
  chemically synthesized
AGLGVVER

SEQ ID NO: 604 - protein, 8 aa, Artificial Sequence
  chemically synthesized
AGLGISST

SEQ ID NO: 605 - protein, 8 aa, Artificial Sequence
  chemically synthesized
EPQALAMS

SEQ ID NO: 606 - protein, 8 aa, Artificial Sequence
  chemically synthesized
QALAMSAI

SEQ ID NO: 607 - protein, 8 aa, Artificial Sequence
  chemically synthesized
AAYHLVSQ

SEQ ID NO: 608 - protein, 8 aa, Artificial Sequence
  chemically synthesized
MDAFLESS

SEQ ID NO: 609 - protein, 8 aa, Artificial Sequence
  chemically synthesized
ESLPVVAV

SEQ ID NO: 610 - protein, 8 aa, Artificial Sequence
  chemically synthesized
SAPAVESE

SEQ ID NO: 611 - protein, 8 aa, Artificial Sequence
  chemically synthesized
DVAQFVLT

SEQ ID NO: 612 - protein, 8 aa, Artificial Sequence
  chemically synthesized
VAQFVLTE

SEQ ID NO: 613 - protein, 8 aa, Artificial Sequence
  chemically synthesized
AQFVLTEG

SEQ ID NO: 614 - protein, 8 aa, Artificial Sequence
  chemically synthesized
PVQPIGPQ

SEQ ID NO: 615 - protein, 113 aa, Artificial Sequence
  chemically synthesized
QVQLVESGGDVVQPGGSLRLSCAASGVAFSNYGMHWVRQAPGKGLEWVAVIWYDGSNKYYADSVKGRFTISRDNSKNMLYLQMNSLRAEDTAMYYCARNDDYWGQGTLVTVSS

SEQ ID NO: 616 - DNA, 447 bp, Artificial Sequence
  chemically synthesized
gcgtgccgtatttgtcaggatcatcctgcgacgaagtggaattctggaggtggctcgagcggcggctctatctcttccggactgctgtccggcagatccgctaatcccggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 617 - protein, 113 aa, Artificial Sequence
  chemically synthesized
QVQLVESGGDVVQPGRSLRLSCAASGLTFTNYGFHWVRQAPGKGLEWVAVIWYDGSKKYYADSVKGRFTISRDNSKNTLYLQMNNLRAEDTAVYYCATGDDYWGQGTLVTVSS

SEQ ID NO: 618 - protein, 113 aa, Artificial Sequence
  chemically synthesized
QVYLVESGGGVVQPGRSLRLSCAASGFTFSNYGMHWVRQAPGKGLEWVALIWYDGSNKYYADSVKGRFTISRDNSKNTLYLQMTSLRVEDTAVYYCASNVDHWGQGTLVTVSS

SEQ ID NO: 619 - protein, 119 aa, Artificial Sequence
  chemically synthesized
QVQLQQSGAELMKPGASVKMSCKTTGYIFSSYWIGWVKQRPGHGLEWIGKIFPGSGSADYNENFKGKATFTVDTSSNTAYMQLSSLTSEDSAVYYCARGYGNYLYFDVWGAGTTVTVSS

SEQ ID NO: 620 - protein, 121 aa, Artificial Sequence
  chemically synthesized
QLQLQESGPGLVKPSETLSLTCTVSGGSLSRSSFFWGWIRQPPGKGLEWIGSIYYSGSTYYNPSLKSRVTISVDTSKNQFSLKLSSVTAADTAVYYCVRDYDILTGDEDYWGQGTLVTVSS

SEQ ID NO: 621 - protein, 113 aa, Artificial Sequence
  chemically synthesized
QVQLVESGGGVVQPGRSLRLSCTTSGITFSSYGFHWVRQAPGKGLEWVAVIWYDGSKKYYADSVKGRFTLSRDDSKNTLYLQMNSLRAEDTAVYYCVTGDDYWGQGTLVTVSS

SEQ ID NO: 622 - protein, 7 aa, Artificial Sequence
  chemically synthesized
MSYNGNN

SEQ ID NO: 623 - protein, 121 aa, Artificial Sequence
  chemically synthesized
QLQLQESGPGLVKPSETLSLTCSVSGGSLSRSSYFWGWIRQPPGKGLEWIASIFYSGETYFNPSLKSRVTISVDTSRNQFSLKLSSVTAADTAVYYCARDYDILTGDEDYWGQGTLVTVSS

SEQ ID NO: 624 - protein, 107 aa, Artificial Sequence
  chemically synthesized
EIVLTQSPATLSLSPGERATLSCRASQSVSSYLAWYQQKPGQAPRLIIYDASNRATGIPARFSGSGSGTDFTLTISSLEPEDFAVYYCQQRSNWPLTFGGGTKVEIK

SEQ ID NO: 625 - protein, 107 aa, Artificial Sequence
  chemically synthesized
EIVLTQSPATLSLSPGERATLSCRASQSVSSYLAWYQQKPGQAPRLLIYDTSNRATGIPARFSGSGSGTDFTLTISSLEPEDFAVYYCQQRSNWPLTFGGGTKVEIK

SEQ ID NO: 626 - protein, 107 aa, Artificial Sequence [sequence omitted]

SEQ ID NO: 627 - protein, 119 aa, Artificial Sequence
  chemically synthesized
EVQLVLSGGGFVQPGGSLKLSCAASGFTFSSYAMSWVRQNPERRLVWVATITGGGRNTYYPDSVKGRFTISRDNAKNTLYLQMSSLRSEDTAMYYCTRQGYDGYTWFAYWGQGTLVTVS

SEQ ID NO: 628 - protein, 107 aa, Artificial Sequence
  chemically synthesized
DIQMTQSPSSLSASVGDRVSITCRASQGISSWLAWYQQKPEKAPKSLIYAASNLRSGVPSRFSGSGSGTDFTLTISSLQPEDFATYYCQQYYSYPRTFGQGTKVEIK

SEQ ID NO: 629 - protein, 107 aa, Artificial Sequence
  chemically synthesized
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 630 - protein, 107 aa, Artificial Sequence
  chemically synthesized
DIQMTQSPSSLSASVGDRVTITCRASQGISSWLAWYQQKPEKAPKSLIYAASSLQSGVPSRFSGSGSGTDFTLTISSLQPEDFATYYCQQYYSYPRTFGQGTKVEIK

SEQ ID NO: 631 - protein, 122 aa, Artificial Sequence
  chemically synthesized
QVQLQQPGAELVKPGASVKLSCKASGYTFTSYYLYWMKQRPGQGLEWIGGVNPSNGGTNFSEKFKSKATLTVDKSSSTAYMQLSSLTSEDSAVYYCTRRDSNYDGGFDYWGQGTTLTVSSAK

SEQ ID NO: 632 - protein, 122 aa, Artificial Sequence
  chemically synthesized
QVQLQQPGAELVKPGTSVKLSCKASGYTFTNYYMYWVKQRPGQGLEWIGGINPSNGGTNFNEKFKNKATLTVDSSSSTTYMQLSSLTSEDSAVYYCTRRDYRFDMGFDYWGQGTTLTVSSAK

SEQ ID NO: 633 - protein, 139 aa, Artificial Sequence
  chemically synthesized
MDWTWSILFLVAAPTGAHSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSS

SEQ ID NO: 634 - protein, 120 aa, Artificial Sequence [sequence omitted]

SEQ ID NO: 635 - protein, 111 aa, Artificial Sequence
  chemically synthesized
DIVLTQSPTSLAVSLGQRATISCRASKSVSTSGFSYLHWYQQKPGQPPKLLIFLASNLESGVPARFSGSGSGTDFTLNIHPVEEEDAATYYCQHSWELPLTFGAGTKLELK

SEQ ID NO: 636 - protein, 111 aa, Artificial Sequence
  chemically synthesized
DIVLTQSPASLAVSLGQRAAISCRASKGVSTSGYSYLHWYQQKPGQSPKLLIYLASYLESGVPARFSGSGSGTDFTLNIHPVEEEDAATYYCQHSRDLPLTFGTGTKLELK

SEQ ID NO: 637 - protein, 130 aa, Artificial Sequence
  chemically synthesized
MAPVQLLGLLVLFLPAMRCEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 638 - protein, 111 aa, Artificial Sequence [sequence omitted]

SEQ ID NO: 639 - protein, 130 aa, Artificial Sequence
  chemically synthesized
MAPVQLLGLLVLFLPAMRCEIVLTQSPLSLPVTPGEPASISCRASKGVSTSGYSYLHWYLQKPGQSPQLLIYLASYLESGVPDRFSGSGSGTDFTLKISRVEAEDVGVYYCQHSRDLPLTFGQGTKLEIK

SEQ ID NO: 640 - protein, 111 aa, Artificial Sequence
  chemically synthesized
EIVLTQSPLSLPVTPGEPASISCRASKGVSTSGYSYLHWYLQKPGQSPQLLIYLASYLESGVPDRFSGSGSGTDFTLKISRVEAEDVGVYYCQHSRDLPLTFGQGTKLEIK

SEQ ID NO: 641 - protein, 130 aa, Artificial Sequence
  chemically synthesized
MAPVQLLGLLVLFLPAMRCDIVMTQTPLSLPVTPGEPASISCRASKGVSTSGYSYLHWYLQKPGQSPQLLIYLASYLESGVPDRFSGSGSGTAFTLKISRVEAEDVGLYYCQHSRDLPLTFGQGTKLEIK

SEQ ID NO: 642 - protein, 111 aa, Artificial Sequence
  chemically synthesized
DIVMTQTPLSLPVTPGEPASISCRASKGVSTSGYSYLHWYLQKPGQSPQLLIYLASYLESGVPDRFSGSGSGTAFTLKISRVEAEDVGLYYCQHSRDLPLTFGQGTKLEIK

SEQ ID NO: 643 - protein, 466 aa, Artificial Sequence
  chemically synthesized
MAVLGLLFCLVTFPSCVLSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 644 - protein, 447 aa, Artificial Sequence
  chemically synthesized
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 645 - protein, 469 aa, Artificial Sequence
  chemically synthesized
MAVLGLLFCLVTFPSCVLSQVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 646 - protein, 450 aa, Artificial Sequence
  chemically synthesized
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 647 - protein, 237 aa, Artificial Sequence
  chemically synthesized
MAPVQLLGLLVLFLPAMRCEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 648 - protein, 218 aa, Artificial Sequence
  chemically synthesized
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 649 - protein, 237 aa, Artificial Sequence
  chemically synthesized
MAPVQLLGLLVLFLPAMRCEIVLTQSPLSLPVTPGEPASISCRASKGVSTSGYSYLHWYLQKPGQSPQLLIYLASYLESGVPDRFSGSGSGTDFTLKISRVEAEDVGVYYCQHSRDLPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 650 - protein, 218 aa, Artificial Sequence
  chemically synthesized
EIVLTQSPLSLPVTPGEPASISCRASKGVSTSGYSYLHWYLQKPGQSPQLLIYLASYLESGVPDRFSGSGSGTDFTLKISRVEAEDVGVYYCQHSRDLPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 651 - protein, 237 aa, Artificial Sequence
  chemically synthesized
MAPVQLLGLLVLFLPAMRCDIVMTQTPLSLPVTPGEPASISCRASKGVSTSGYSYLHWYLQKPGQSPQLLIYLASYLESGVPDRFSGSGSGTAFTLKISRVEAEDVGLYYCQHSRDLPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 652 - protein, 218 aa, Artificial Sequence
  chemically synthesized
DIVMTQTPLSLPVTPGEPASISCRASKGVSTSGYSYLHWYLQKPGQSPQLLIYLASYLESGVPDRFSGSGSGTAFTLKISRVEAEDVGLYYCQHSRDLPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 653 - protein, 10 aa, Artificial Sequence
  chemically synthesized
GFTFSGYAMS

SEQ ID NO: 654 - protein, 10 aa, Artificial Sequence
  chemically synthesized
GYTFTDYYMD

SEQ ID NO: 655 - protein, 10 aa, Artificial Sequence
  chemically synthesized
GFTFSNYAMS

SEQ ID NO: 656 - protein, 10 aa, Artificial Sequence
  chemically synthesized
GFSFSSYDMS

SEQ ID NO: 657 - protein, 10 aa, Artificial Sequence
  chemically synthesized
GFTFSSYGMS

SEQ ID NO: 658 - protein, 10 aa, Artificial Sequence
  chemically synthesized
YISNSGGNAH

SEQ ID NO: 659 - protein, 10 aa, Artificial Sequence
  chemically synthesized
YIYPKNGGSS

SEQ ID NO: 660 - protein, 10 aa, Artificial Sequence
  chemically synthesized
YISNGGGDTH

SEQ ID NO: 661 - protein, 10 aa, Artificial Sequence
  chemically synthesized
TISGGGRYTY

SEQ ID NO: 662 - protein, 10 aa, Artificial Sequence
  chemically synthesized
TISGGGRDIY

SEQ ID NO: 663 - protein, 10 aa, Artificial Sequence
  chemically synthesized
YISNSGGNTH

SEQ ID NO: 664 - protein, 10 aa, Artificial Sequence
  chemically synthesized
EDYGTSPFVY

SEQ ID NO: 665 - protein, 7 aa, Artificial Sequence
  chemically synthesized
KVVATDY

SEQ ID NO: 666 - protein, 10 aa, Artificial Sequence
  chemically synthesized
ENYGTSPFVY

SEQ ID NO: 667 - protein, 7 aa, Artificial Sequence
  chemically synthesized
NYYGFDY

SEQ ID NO: 668 - protein, 7 aa, Artificial Sequence
  chemically synthesized
LYLGFDY

SEQ ID NO: 669 - protein, 15 aa, Artificial Sequence
  chemically synthesized
RASESVDNYGISFMN

SEQ ID NO: 670 - protein, 16 aa, Artificial Sequence
  chemically synthesized
KSSQSLLYSSNQKNYL

SEQ ID NO: 671 - protein, 11 aa, Artificial Sequence
  chemically synthesized
KASQDVGTAVA

SEQ ID NO: 672 - protein, 11 aa, Artificial Sequence
  chemically synthesized
LASQTIGTWLA

SEQ ID NO: 673 - protein, 15 aa, Artificial Sequence
  chemically synthesized
RASESVDNYGISFMN

SEQ ID NO: 674 - protein, 15 aa, Artificial Sequence
  chemically synthesized
RASESVDQYGISFMN

SEQ ID NO: 675 - protein, 15 aa, Artificial Sequence
  chemically synthesized
RASESVDSYGISFMN

SEQ ID NO: 676 - protein, 15 aa, Artificial Sequence
  chemically synthesized
RASESVDAYGISFMN

SEQ ID NO: 677 - protein, 17 aa, Artificial Sequence
  chemically synthesized
KSSQSLLYSSNQKNYLA

SEQ ID NO: 678 - protein, 7 aa, Artificial Sequence
  chemically synthesized
AASNQGS

SEQ ID NO: 679 - protein, 7 aa, Artificial Sequence
  chemically synthesized
WASIRES

SEQ ID NO: 680 - protein, 7 aa, Artificial Sequence
  chemically synthesized
WASTRHT

SEQ ID NO: 681 - protein, 7 aa, Artificial Sequence
  chemically synthesized
AATSLAD

SEQ ID NO: 682 - protein, 7 aa, Artificial Sequence
  chemically synthesized
AASDQGS

SEQ ID NO: 683 - protein, 9 aa, Artificial Sequence
  chemically synthesized
QQSKDVPWT

SEQ ID NO: 684 - protein, 9 aa, Artificial Sequence
  chemically synthesized
QQCDSYPWT

SEQ ID NO: 685 - protein, 9 aa, Artificial Sequence
  chemically synthesized
QQYSSYPWT

SEQ ID NO: 686 - protein, 9 aa, Artificial Sequence
  chemically synthesized
QQLYSIPWT

SEQ ID NO: 687 - protein, 9 aa, Artificial Sequence
  chemically synthesized
QQSDSYPWT

SEQ ID NO: 688 - protein, 5 aa, Artificial Sequence
  chemically synthesized
NYGMH

SEQ ID NO: 689 - protein, 5 aa, Artificial Sequence
  chemically synthesized
NYGFH

SEQ ID NO: 690 - protein, 5 aa, Artificial Sequence
  chemically synthesized
NSGMH

SEQ ID NO: 691 - protein, 7 aa, Artificial Sequence
  chemically synthesized
RSSFFWG

SEQ ID NO: 692 - protein, 5 aa, Artificial Sequence
  chemically synthesized
SYGFH

SEQ ID NO: 693 - protein, 7 aa, Artificial Sequence
  chemically synthesized
RSSYFWG

SEQ ID NO: 694 - protein, 17 aa, Artificial Sequence
  chemically synthesized
VIWYDGSNKYYADSVKG

SEQ ID NO: 695 - protein, 17 aa, Artificial Sequence
  chemically synthesized
VIWYDGSKKYYADSVKG

SEQ ID NO: 696 - protein, 17 aa, Artificial Sequence
  chemically synthesized
LIWYDGSNKYYADSVKG

SEQ ID NO: 697 - protein, 17 aa, Artificial Sequence
  chemically synthesized
VIWYDGSKRYYADSVKG

SEQ ID NO: 698 - protein, 16 aa, Artificial Sequence
  chemically synthesized
SIYYSGSTYYNPSLKS

SEQ ID NO: 699 - protein, 16 aa, Artificial Sequence
  chemically synthesized
SIFYSGETYFNPSLKS

SEQ ID NO: 700 - protein, 4 aa, Artificial Sequence
  chemically synthesized
NDDY

SEQ ID NO: 701 - protein, 4 aa, Artificial Sequence
  chemically synthesized
GDDY

SEQ ID NO: 702 - protein, 4 aa, Artificial Sequence
  chemically synthesized
NVDH

SEQ ID NO: 703 - protein, 11 aa, Artificial Sequence
  chemically synthesized
DYDILTGDEDY

SEQ ID NO: 704 - protein, 11 aa, Artificial Sequence
  chemically synthesized
RASQSVSSYLA

SEQ ID NO: 705 - protein, 11 aa, Artificial Sequence
  chemically synthesized
RASQGISSWLA

SEQ ID NO: 706 - protein, 7 aa, Artificial Sequence
  chemically synthesized
DASNRAT

SEQ ID NO: 707 - protein, 7 aa, Artificial Sequence
  chemically synthesized
DTSNRAT

SEQ ID NO: 708 - protein, 7 aa, Artificial Sequence
  chemically synthesized
AASNLRS

SEQ ID NO: 709 - protein, 7 aa, Artificial Sequence
  chemically synthesized
AASSLQS

SEQ ID NO: 710 - protein, 9 aa, Artificial Sequence
  chemically synthesized
QQRSNWPLT

SEQ ID NO: 711 - protein, 9 aa, Artificial Sequence
  chemically synthesized
QQSSNWPRT

SEQ ID NO: 712 - protein, 9 aa, Artificial Sequence
  chemically synthesized
QQYYSYPRT

SEQ ID NO: 713 - protein, 5 aa, Artificial Sequence
  chemically synthesized
SYYLY

SEQ ID NO: 714 - protein, 5 aa, Artificial Sequence
  chemically synthesized
NYYMY

SEQ ID NO: 715 - protein, 17 aa, Artificial Sequence
  chemically synthesized
GVNPSNGGTNFSEKFKS

SEQ ID NO: 716 - protein, 17 aa, Artificial Sequence
  chemically synthesized
GINPSNGGTNFNEKFKN

SEQ ID NO: 717 - protein, 11 aa, Artificial Sequence
  chemically synthesized
RDSNYDGGFDY

SEQ ID NO: 718 - protein, 11 aa, Artificial Sequence
  chemically synthesized
RDYRFDMGFDY

SEQ ID NO: 719 - protein, 15 aa, Artificial Sequence
  chemically synthesized
RASKSVSTSGFSYLH

SEQ ID NO: 720 - protein, 15 aa, Artificial Sequence
  chemically synthesized
RASKGVSTSGYSYLH

SEQ ID NO: 721 - protein, 7 aa, Artificial Sequence
  chemically synthesized
LASNLES

SEQ ID NO: 722 - protein, 7 aa, Artificial Sequence
  chemically synthesized
LASYLES

SEQ ID NO: 723 - protein, 9 aa, Artificial Sequence
  chemically synthesized
QHSWELPLT

SEQ ID NO: 724 - protein, 9 aa, Artificial Sequence
  chemically synthesized
QHSRDLPLT

SEQ ID NO: 725 - protein, 112 aa, Artificial Sequence
  chemically synthesized
DIVLTQSPTSLAVSLGQRATISCRASESVDNSGISFMNWFQQKPGQPPKLLIYAASNPGSGVPARFSGSGSGTDFSLNIHPMEEDDTAMYFCQQSKEVPWTFGGGTELEIKR

SEQ ID NO: 726 - protein, 118 aa, Artificial Sequence
  chemically synthesized
DVQLQESGPGLVKPSQSLSLTCTVTGYSITSDYAWNWIRQFPGNKLEWMGYINYSGSTSYNPSLKSRISITRDTSKNQFFLQLNSVTTEDTATYYCARWIGSSAWYFDVWGAGTTVTV

SEQ ID NO: 727 - protein, 112 aa, Artificial Sequence
  chemically synthesized
DVLMTQTPLSLPVSLGDQASISCRSGQNIVHSNGNTYLEWYLQKPGQSPKLLIYKVSNRFFGVPDRISGSGSGTDFTLKISRVEAEDLGVYFCFQGSHVPFTFGSGTKLEIK

SEQ ID NO: 728 - protein, 118 aa, Artificial Sequence
  chemically synthesized
QVQLQQPGAELVKPGASVKLSCKASGYTFTTYYLYWVRQRPGQGLEWIGGINPSNGGTNFNEKFKSKATLTVDKSSSTAYMQLNSLTSEDSAVYYCTRRDYRYDRGFDYWGQGTSVTV

SEQ ID NO: 729 - protein, 111 aa, Artificial Sequence
  chemically synthesized
DIVLTQSPASLAVSLGQRATISCRASKSVSTSGFNYIHWYQQKPGQPPKLLIYLASNLESGVPARFSGSGSGTDFTLNIHPVEDEDAATYYCQHSRELPLTFGAGTKLEIK

SEQ ID NO: 730 - protein, 118 aa, Artificial Sequence
  chemically synthesized
QVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTV

SEQ ID NO: 731 - protein, 108 aa, Artificial Sequence
  chemically synthesized
ENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIK

SEQ ID NO: 732 - protein, 434 aa, Artificial Sequence
  chemically synthesized
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 733 - protein, 119 aa, Artificial Sequence
  chemically synthesized
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 734 - protein, 119 aa, Artificial Sequence
  chemically synthesized
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 735 - protein, 127 aa, Artificial Sequence
  chemically synthesized
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 736 - protein, 125 aa, Artificial Sequence
  chemically synthesized
GAHSEVQLVQSGGGVVQPGRSLRLSCAASGFTFSSYWCDRMSWVRQAPGKGLEWVSAISGSGGSTYYADSVKGRFTISRDNSKNTLYLQMNSLRAEDTAVYYCAKENWGSYFDLWGQGTTVTVSS

SEQ ID NO: 737 - protein, 108 aa, Artificial Sequence
  chemically synthesized
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 738 - protein, 111 aa, Artificial Sequence
  chemically synthesized
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 739 - protein, 112 aa, Artificial Sequence
  chemically synthesized
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVLGE

SEQ ID NO: 740 - protein, 112 aa, Artificial Sequence
  chemically synthesized
GVHSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 741 - protein, 121 aa, Artificial Sequence
  chemically synthesized
QVQLVQSGHEVKQPGASVKMSCKASGYSFTSSWIHWVKQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 742 - protein, 121 aa, Artificial Sequence
  chemically synthesized
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 743 - protein, 111 aa, Artificial Sequence
  chemically synthesized
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 744 - protein, 111 aa, Artificial Sequence
  chemically synthesized
DIVLTQSPATLSLSPGQRLTISCRASQSVSTSGYSYMHWYQQKPDQSPKLLIKFGSNLESGIPARFSGSGSGTDFTLTISSLEPEDFAVYYCQHSWEIPYTFGQGTKLEIK

SEQ ID NO: 745 - protein, 125 aa, Artificial Sequence [sequence omitted]

SEQ ID NO: 746 - protein, 112 aa, Artificial Sequence [sequence omitted]

SEQ ID NO: 747 - protein, 161 aa, Artificial Sequence
  chemically synthesized
MGLGLQWVFFVALLKGVHCEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSATTTAPSVYPLAPACDSTTKS

SEQ ID NO: 748 - protein, 214 aa, Artificial Sequence; identical to SEQ ID NO: 543
  chemically synthesized

SEQ ID NO: 749 - protein, 551 aa, Artificial Sequence
  chemically synthesized
METDTLLLWVLLLWVPGSTGDAAQPARRARRTKLGTELGSPGLQEFEVRLLESGGGLVKPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGGGGSGGGGSGGGGSEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGPRGGPEQKLISEEDLNSAVDHHHHHH

SEQ ID NO: 750 - protein, 117 aa, Artificial Sequence
  chemically synthesized
QLVQSGAEVKKPGASVKVSCKASGYTFTSYGISWVRQAPGQGLEWMGWISAYNGNTNYAQKLQGRVTMTTDTSTSTATMELRSLRSDDTAVYYCARGRGYSYGIDAFDIWGQGTMVT

SEQ ID NO: 751 - protein, 112 aa, Artificial Sequence
  chemically synthesized
LSYVLTQPPSVSVSPGQTARITCSGDALPKQYAYWYQQKPGQAPVLVIYKDSERPSGIPERFSGSSSGTTVTLTISGVQAEDEADYYCQSADSSGTYVVFGGGTKLTVLGQP

SEQ ID NO: 752 - protein, 121 aa, Artificial Sequence
  chemically synthesized
QVQLQQSGPGLVRPSQTLSLSCDISGDSVSSNSATWNWIRQSPSRGLEWLGRTFYRSKWYHDYALSVKSRITINPDTSKNQFSLQLNSVSPGDTAVYFCVREDIDGRLDYWGQGTLVTVSS

SEQ ID NO: 753 - protein, 119 aa, Artificial Sequence
  chemically synthesized
QVQLVQSGSELKKPGASVKISCKASGYIFSDNGVNWVRQAPGQGLEWMGWINTKIGNPTYAQGFTGRFVFSLDTSVSTTYLQISSLQAGDTAVYYCAREHDYYYGMDVWGQGTTVTVSS

SEQ ID NO: 754 - protein, 122 aa, Artificial Sequence
  chemically synthesized
MAEVQLLESGAEVKKPGASVKVSCKASGYTFTSHYMHWVRQAPGQGLEWMGVINPSGGSTSYAQKFQGRVTMTRDTSTSTVYMDLSSLRSEDTAVYYCARRSEAYYHGMDVWGQGTTVTVSS

SEQ ID NO: 755 - protein, 119 aa, Artificial Sequence
  chemically synthesized
EVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 756 - protein, 131 aa, Artificial Sequence
  chemically synthesized
QVQLVESGGGLVQPGGSLRLSCEATGFTFSRYWMHWVRQAPGKGLEWVSSISSSSSYIYYADSVKGRFTISRDNAKNSLYLQMNSLRAEDTAVYYCARDTLEYYGSGILENAMGYYGMDVWGQGTTVTVSS

SEQ ID NO: 757 - protein, 119 aa, Artificial Sequence
  chemically synthesized
EVQLVESGGGLVRPGGSLRLACAASGFSFSDYYMTWIRQAPGRGLEWIAYISDSGQTVHYADSVKGRFTISRDNTKNSLFLQVNTLRAEDTAVYYCAREDLLGYYLQSWGQGTLVTVSS

SEQ ID NO: 758 - protein, 118 aa, Artificial Sequence
  chemically synthesized
EVQLVESGGGVVQPGRSLRLSCAASGFTFSSYWMSWVRQAPGKGLEWVANIKQDGSEKYYVDSVKGRFTISRDNAKNSLYLQMNSLRAEDTAVYYCAREGEHDAFDIWGQGTMVTVSS

SEQ ID NO: 759 - protein, 119 aa, Artificial Sequence; identical to SEQ ID NO: 753
  chemically synthesized

SEQ ID NO: 760 - protein, 119 aa, Artificial Sequence; identical to SEQ ID NO: 753
  chemically synthesized

SEQ ID NO: 761 - protein, 120 aa, Artificial Sequence
  chemically synthesized
QVQLVQSGAEVKKPGASVKVSCKASGYTFTRYTMHWVRQAPGQRLEWMGWINAGNGNTKYSQKFQGRVTITRDTSASTAYMELSSLRSEDTAVYYCAKVSAGTESWFDPWGQGTLVTVSS

SEQ ID NO: 762 - protein, 117 aa, Artificial Sequence
  chemically synthesized
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGLYGDEDYWGQGTLVTVSS

SEQ ID NO: 763 - protein, 119 aa, Artificial Sequence
  chemically synthesized
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 764 - protein, 125 aa, Artificial Sequence
  chemically synthesized
QMQLVQSGAEVKKPGESLKISCKGSGYSFTSYWIGWVRQMPGKGLEWMGIIYPGDSDTRYSPSFQGQVTISADKSISTAYLQWSSLKASDTAMYYCASGVTRKRYSSSWPPFDYWGQGTLVTVSS

SEQ ID NO: 765 - protein, 120 aa, Artificial Sequence
  chemically synthesized
QVQLQQWGAGLLKSSETLSLSCAVYGGTFRDDHWSWIRQPPGKGLEWIGESHHTGRTIYNPSLRSRVTMSIDTSKNEFSLILRSVTAADTATYFCARGNNYVWGNQEDFWGQGTLVTVSS

SEQ ID NO: 766 - protein, 121 aa, Artificial Sequence; identical to SEQ ID NO: 752
  chemically synthesized

SEQ ID NO: 767 - protein, 123 aa, Artificial Sequence
  chemically synthesized
EVQLVESGGALVQPGGSLRLSCAVSGFTFSDHYMDWVRQAPGKGLEWVARSRNKGNSYTTEYAASVRGRFTISRDDSKNSLYLQMNSLKTEDTAVYYCVRVGVVPALDGMDVWGQGTTVTVSS

SEQ ID NO: 768 - protein, 131 aa, Artificial Sequence
  chemically synthesized
EVQLVESGGGLVQPGGSLRLSCAASGFTFSSYWMHWVRQAPGKGLEWVSSISSSSSYIYYADSVKGRFTISRDNAKNSLYLQMNSLRAEDTAVYYCARDTLEYYGSGILENAMGYYGMDVWGQGTTVTVSS

SEQ ID NO: 769 - protein, 123 aa, Artificial Sequence
  chemically synthesized
EVQLLESGGGVVQTGRSLRLSCSDSGSTFRSQAMHWVRQTPGKGLEWLAVTSHDGSKTYYADSVKGRFTISRDNSKNTLYLQMNSLRGEDTAVYYCARGGRGYTYDHSFFDYWGQGTLVTVSS

SEQ ID NO: 770 - protein, 119 aa, Artificial Sequence
  chemically synthesized
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 771 - protein, 119 aa, Artificial Sequence
  chemically synthesized
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 772 - protein, 119 aa, Artificial Sequence
  chemically synthesized
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 773 - protein, 118 aa, Artificial Sequence
  chemically synthesized
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 774 - protein, 119 aa, Artificial Sequence
  chemically synthesized
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 775 - protein, 119 aa, Artificial Sequence
  chemically synthesized
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 776 - protein, 119 aa, Artificial Sequence
  chemically synthesized
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 777 - protein, 111 aa, Artificial Sequence
  chemically synthesized
LPVLTQPASVSGSPGQSITISCTGTSSDVGGYNYVSWYQQHPGKAPKLMIYEVSKRPSGVPDRFSGSKSGNTASLTVSGLQAEDEADYYCSAWDDSLNADVFGGGTKLTVL

SEQ ID NO: 778 - protein, 110 aa, Artificial Sequence
  chemically synthesized
QPVLTQPPSASGTPGQRVTISCSGSSSNIGTNTVNWYQQVPGTAPKLLIHGNDQRPSGVPDRFSGSKSDTSASLAITGLQSDDDADYYCSAWDDSLNADVFGGGTKLTVL

SEQ ID NO: 779 - protein, 110 aa, Artificial Sequence
  chemically synthesized
QAVLTQPPSASATPGQRVTISCSGSDSNIGTNYVYWYQQFPGTAPQPLIYRDNQRPSGVPDRFSGSKSGTSASLAISGLRSEDEATYFCSTWDDSLNGWVFGGGTKLTVL

SEQ ID NO: 780 - protein, 111 aa, Artificial Sequence
  chemically synthesized
QPVLTQPRSVSGSPGQSITTSCTGTSSDVGGYNYVSWYQQHPGKAPKLMIYEVSNRPSGVSNRFSGSKSGNTASLTISGLQAEDEADYYCSSYTSSSTLEVFGTGTKVTVL

SEQ ID NO: 781 - protein, 110 aa, Artificial Sequence
  chemically synthesized
YELMQPPSVSGAPGQRVTISCTGSSSNIGAAYDVHWYQQLPGKAPKLVMFANSNRPSGVPDRFSGSKSGTSASLAITGLQAEDEADYYCQSYDISLRAYVFGTGTKLTVL

SEQ ID NO: 782 - protein, 110 aa, Artificial Sequence
  chemically synthesized
SYELMQPPSASGTPGQRVTISCSGSSSNIGTNTVNWYQHLPGTAPKLLIYSNNQRPSGVPDRFSGSKSGTSASLAISGLQSEDEADYYCATWDDSPNGWVFGGGTKLTVL

SEQ ID NO: 783 - protein, 109 aa, Artificial Sequence
  chemically synthesized
QAVLTQPPSVSAAPGQRVTISCSGSNSNIADTYVSWYQQLPGTAPRLLIYDNDQRPSGIPDRFSGSKSGTSATLGITGLQTGDEADYYCGTWDSSLSGVFGTGTKVTVL

SEQ ID NO: 784 - protein, 109 aa, Artificial Sequence
  chemically synthesized
QSVLTQPASVSGSPGQSVTISCTGSSSDVGAYNFVSWYRQYPGKAPKLLIYEVNKRPSDVPDRFSGSKFGNTASLTVSGLQADDEADYYCSSYAGSTDVFGTGTKVTVL

SEQ ID NO: 785 - protein, 110 aa, Artificial Sequence
  chemically synthesized
LPVLTQPPSVSGTPGQRVTISCSGSSSNIGSNTVNWYQQLPGTAPKLLIYTNNQRPSGVPDRFSGSKSGTSASLAISGLQSEDEADYYCAAWDESLNGDVFGTGTKVTVL

SEQ ID NO: 786 - protein, 107 aa, Artificial Sequence
  chemically synthesized
AIRMTQSPSFLSASVGDRVTITCRTSQNIYNYLNWYQQKPGKAPELLIFVASSLQSGVPSRFSGSGSGTDFTLTISSLQPEDFATYFCLQDHSYPYTFGQGTKVEIK

SEQ ID NO: 787 - protein, 110 aa, Artificial Sequence
  chemically synthesized
LPVLTQPPSVSEVPGQRVTISCSGGISNIGSNAVNWYQHFPGKAPKLLIYYNDLLPSGVSDRFSASKSGTSASLAISGLRSEDEADYYCAAWDDNLSAYVFATGTKVTVL

SEQ ID NO: 788 - protein, 111 aa, Artificial Sequence
  chemically synthesized
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 789 - protein, 107 aa, Artificial Sequence
  chemically synthesized
DIQMTQSPSSLSASVGDRVTITCRASQSISTYLNWYQQKPGKAPKVLITDASSLETGVPSRFSGSGSGTDFTFTISSLQPEDTATYFCQQYDDLPPTFGQGTKLEIK

SEQ ID NO: 790 - protein, 110 aa, Artificial Sequence
  chemically synthesized
QAGLTQPRSVSGSPGQSVTISCTGTSSDVGGYNYVSWYQQHPGKAPKLMIYDVTKRPSGVSNRFSGSKSGNTASLTISGLQAEDEADYYCSSYTSSSTYVFGTGTKVTVL

SEQ ID NO: 791 - protein, 111 aa, Artificial Sequence
  chemically synthesized
QPVLTQPASVSGSPGQSITISCTGTSSDVGGYNYVSWYQQHPGKAPKLMIYDVSNRPSGVSNRFSGSKSGNTASLAITGLQSDDDADYYCSAWDDSLNADVFGGGTKLTVL

SEQ ID NO: 792 - protein, 110 aa, Artificial Sequence
  chemically synthesized
QAGLTQPPSVSKGLRQTATLTCTGNSNNIGDQGAAWLQQHQGHPPRLLSYRNNNRPSGISERLSASRSGNIASLTITGLQPEDEADYYCSAWDSSLSVWVFGGGTKLTVL

SEQ ID NO: 793 - protein, 110 aa, Artificial Sequence
  chemically synthesized
QAVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVL

SEQ ID NO: 794 - protein, 107 aa, Artificial Sequence
  chemically synthesized
AIRMTQSPSTLSASVGDRVTITCRASENIRNLLAWYQQKPGKAPELLIHGASTLGTGVPSRFSGGGSGTEFTLTISSLQPDDFATYYCQQYESYFNTFGQGTKVEIK

SEQ ID NO: 795 - protein, 118 aa, Artificial Sequence
  chemically synthesized
QVQLVESGPGVKKPGSSLKLSCTVSGFTFSSYDYYMHWVRQAPGNGLEWMAVIWYSGSNTYYNDSLKSRFSITRDNSKNTAYMQLNSLRAEDTAVYYCARAYFGVDVWGQGTLVTVSS

SEQ ID NO: 796 - protein, 113 aa, Artificial Sequence
  chemically synthesized
DIVMTQSPASLSVSVGDRATISCRASQGIGNTLAWYQQKPGQAPKRLLIYRASQGIGNTLAGVPARFSGDGDGTDFTLTIDDLEEPEDFATYYCQQYDHVPLTFGQGTKLEIK

SEQ ID NO: 797 - protein, 119 aa, Artificial Sequence
  chemically synthesized
EVQLVQSGAEVKKPGASVKVSCKAFGYTFTTYPIEWMRQAHGQGLEWIGNFHPYNDDTKYNEKFKGRVTMTVDKSTTTVYMELSSLRSEDTAVYYCARENYGSHGGFVYWGQGTLVTVS

SEQ ID NO: 798 - protein, 119 aa, Artificial Sequence
  chemically synthesized
EVQLVQSGAEVKKPGASVKVSCKAFGYTFTTYPIEWMRQAHGQGLEWIGNFHPYNDDTKYNEKFKGRVTMTRDTSTSTVYMELSSLRSEDTAVYYCARENYGSHGGFVYWGQGTLVTVS

SEQ ID NO: 799 - protein, 119 aa, Artificial Sequence
  chemically synthesized
EVQLVQSGAEVKKPGASVKVSCKAFGYTFTTYPIEWVRQAPGQGLEWMGNFHPYNDDTKYNEKFKGRVTMTRDTSTSTVYMELSSLRSEDTAVYYCARENYGSHGGFVYWGQGTLVTVS

SEQ ID NO: 800 - protein, 119 aa, Artificial Sequence
  chemically synthesized
EVQLVQSGAEVKKPGSSVKVSCKASGYTFTTYPIEWVRQAPGQGLEWMGNFHPYNDDTKYNEKFKGRVTITADKSTSTAYMELSSLRSEDTAVYYCARENYGSHGGFVYWGQGTLVTVS

SEQ ID NO: 801 - protein, 119 aa, Artificial Sequence
  chemically synthesized
EVQLVQSGAEVKKPGSSVKVSCKAFGYTFTTYPIEWMRQAHGQGLEWIGNFHPYNDDTKYNEKFKGRVTITVDKSTTTVYMELSSLRSEDTAVYYCARENYGSHGGFVYWGQGTLVTVS

SEQ ID NO: 802 - protein, 119 aa, Artificial Sequence
  chemically synthesized
EVQLVQSGAEVKKPGSSVKVSCKAFGYTFTTYPIEWMRQAHGQGLEWIGNFHPYNDDTKYNEKFKGRVTITADKSTSTAYMELSSLRSEDTAVYYCARENYGSHGGFVYWGQGTLVTVS

SEQ ID NO: 803 - protein, 108 aa, Artificial Sequence
  chemically synthesized
ENVLTQSPFSLSASVGDRVTITCRASSSVISSYLHWYQQKPAKAPKLWIYSTSNLASGVPDRFSGSGSGTSYTLTISSLQPEDFATYYCQQYNGYPLTFGGGTKVEIK

SEQ ID NO: 804 - protein, 108 aa, Artificial Sequence
  chemically synthesized
ENVLTQSPFSLSASVGDRVTITCRASSSVISSYLHWYQQKPAKAPKLFIYSTSNLASGVPSRFSGSGSGTDYTLTISSLQPEDFATYYCQQYNGYPLTFGGGTKVEIK

SEQ ID NO: 805 - protein, 108 aa, Artificial Sequence
  chemically synthesized
ENVLTQSPFSLSASVGDRVTITCRASSSVISSYLHWYQQKPAKAPKLWIYSTSNLASGVPDRFSGSGSGTSYTLTISSLQPEDFATYYCQQYNSYPLTFGGGTKVEIK

SEQ ID NO: 806 - protein, 108 aa, Artificial Sequence
  chemically synthesized
ENVMTQSPFSLSASVGDRVTITCRASSSVISSYLHWYQQKPAKAPKLFIYSTSNLASGVPSRFSGSGSGTDYTLTISSLQPEDFATYYCQQYNGYPLTFGGGTKVEIK

SEQ ID NO: 807 - protein, 108 aa, Artificial Sequence
  chemically synthesized
ENVMTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIK

SEQ ID NO: 808 - protein, 108 aa, Artificial Sequence
  chemically synthesized
ENVLTQSPFSLSASVGDRVTITCRASSSVISSYLHWYQQKPAKAPKLFIYSTSNLASGVPSRFSGSGSGTDYTLTISSLQPEDFATYYCQQYNSYPLTFGGGTKVEIK

SEQ ID NO: 809 - protein, 108 aa, Artificial Sequence
  chemically synthesized
ENVLTQSPGTLSLSPGERATLSCRASSSVISSYLHWYQQKPGQAPRLWIYSTSNLASGVPDRFSGSGSGTSYTLTISRLEPEDFATYYCQQYNGYPLTFGGGTKVEIK

SEQ ID NO: 810 - protein, 108 aa, Artificial Sequence
  chemically synthesized
ENVLTQSPGTLSLSPGERATLSCRASSSVISSYLHWYQQKPGQAPRLWIYSTSNLASGVPDRFSGSGSGTSYTLTISRLEPEDFATYYCQQYNSYPLTFGGGTKVEIK

SEQ ID NO: 811 - protein, 13 aa, Artificial Sequence
  chemically synthesized
AASGFTFSSFGMS

SEQ ID NO: 812 - protein, 13 aa, Artificial Sequence
  chemically synthesized
KGSGYSFTDYALH

SEQ ID NO: 813 - protein, 13 aa, Artificial Sequence
  chemically synthesized
KASGYAFTSYNIY

SEQ ID NO: 814 - protein, 13 aa, Artificial Sequence
  chemically synthesized
AASGFTFSNYDMS

SEQ ID NO: 815 - protein, 13 aa, Artificial Sequence
  chemically synthesized
AASGFTFNSYGMS

SEQ ID NO: 816 - protein, 13 aa, Artificial Sequence
  chemically synthesized
KGSGYIFTDYVMH

SEQ ID NO: 817 - protein, 17 aa, Artificial Sequence
  chemically synthesized
TITGGGRNTYYPDSVKG

SEQ ID NO: 818 - protein, 16 aa, Artificial Sequence
  chemically synthesized
TISGGGSNTYYPDSVK

SEQ ID NO: 819 - protein, 15 aa, Artificial Sequence
  chemically synthesized
YIDLYNGDTSYNEKF

SEQ ID NO: 820 - protein, 15 aa, Artificial Sequence
  chemically synthesized
YISGGGGNTYYPDTL

SEQ ID NO: 821 - protein, 17 aa, Artificial Sequence
  chemically synthesized
TISGGGSYTYYPDSVQG

SEQ ID NO: 822 - protein, 17 aa, Artificial Sequence
  chemically synthesized
VISTYYSNINYNQKFKG

SEQ ID NO: 823 - protein, 11 aa, Artificial Sequence
  chemically synthesized
QGYDGYTWFAY

SEQ ID NO: 824 - protein, 9 aa, Artificial Sequence
  chemically synthesized
IYDVAWFAY

SEQ ID NO: 825 - protein, 11 aa, Artificial Sequence
  chemically synthesized
EGYGSLFYFDQ

SEQ ID NO: 826 - protein, 8 aa, Artificial Sequence
  chemically synthesized
EGRLSFDY

SEQ ID NO: 827 - protein, 9 aa, Artificial Sequence
  chemically synthesized
ISLTGIFDY

SEQ ID NO: 828 - protein, 9 aa, Artificial Sequence
  chemically synthesized
GNYVYVMDY

SEQ ID NO: 829 - protein, 12 aa, Artificial Sequence
  chemically synthesized
EGFGRPYWYFDV

SEQ ID NO: 830 - protein, 15 aa, Artificial Sequence
  chemically synthesized
RASESVDNSGISFMN

SEQ ID NO: 831 - protein, 16 aa, Artificial Sequence
  chemically synthesized
RSSQTIVHSDGNTYLE

SEQ ID NO: 832 - protein, 15 aa, Artificial Sequence
  chemically synthesized
RASESVDSYGNSFMN

SEQ ID NO: 833 - protein, 16 aa, Artificial Sequence
  chemically synthesized
RSSQSIVQSNGNTYLE

SEQ ID NO: 834 - protein, 16 aa, Artificial Sequence
  chemically synthesized
RSSQTIVHGNGNTYLE

SEQ ID NO: 835 - protein, 11 aa, Artificial Sequence
  chemically synthesized
QASENIYSSLA

SEQ ID NO: 836 - protein, 7 aa, Artificial Sequence
  chemically synthesized
AASNPGS

SEQ ID NO: 837 - protein, 7 aa, Artificial Sequence
  chemically synthesized
KVSNRFS

SEQ ID NO: 838 - protein, 7 aa, Artificial Sequence
  chemically synthesized
LASNLDS

SEQ ID NO: 839 - protein, 7 aa, Artificial Sequence
  chemically synthesized
SASTLAS

SEQ ID NO: 840 - protein, 9 aa, Artificial Sequence
  chemically synthesized
QQSKEVPWT

SEQ ID NO: 841 - protein, 9 aa, Artificial Sequence
  chemically synthesized
FQGSHVPYT

SEQ ID NO: 842 - protein, 9 aa, Artificial Sequence
  chemically synthesized
QQNNEVPLT

SEQ ID NO: 843 - protein, 9 aa, Artificial Sequence
  chemically synthesized
FQGSHVPYT

SEQ ID NO: 844 - protein, 12 aa, Artificial Sequence
  chemically synthesized
QQGFGTSNVENP

SEQ ID NO: 845 - protein, 11 aa, Artificial Sequence
  chemically synthesized
GYSITSDYAWN

SEQ ID NO: 846 - protein, 10 aa, Artificial Sequence
  chemically synthesized
GYTFTTYYLY

SEQ ID NO: 847 - protein, 16 aa, Artificial Sequence
  chemically synthesized
YINYSGSTSYNPSLKS

SEQ ID NO: 848 - protein, 16 aa, Artificial Sequence
  chemically synthesized
GINPSNGGTNFNEKFK

SEQ ID NO: 849 - protein, 11 aa, Artificial Sequence
  chemically synthesized
WIGSSAWYFDV

SEQ ID NO: 850 - protein, 11 aa, Artificial Sequence
  chemically synthesized
RDYRYDRGFDY

SEQ ID NO: 851 - protein, 16 aa, Artificial Sequence
  chemically synthesized
RSGQNIVHSNGNTYLE

SEQ ID NO: 852 - protein, 15 aa, Artificial Sequence
  chemically synthesized
RASKSVSTSGFNYIH

SEQ ID NO: 853 - protein, 7 aa, Artificial Sequence
  chemically synthesized
KVSNRFF

SEQ ID NO: 854 - protein, 7 aa, Artificial Sequence
  chemically synthesized
GYTFTTY

SEQ ID NO: 855 - protein, 9 aa, Artificial Sequence
  chemically synthesized
FQGSHVPFT

SEQ ID NO: 856 - protein, 9 aa, Artificial Sequence
  chemically synthesized
QHSRELPLT

SEQ ID NO: 857 - protein, 5 aa, Artificial Sequence
  chemically synthesized
SYGIS

SEQ ID NO: 858 - protein, 5 aa, Artificial Sequence
  chemically synthesized
SYYIH

SEQ ID NO: 859 - protein, 7 aa, Artificial Sequence
  chemically synthesized
SGAYYWS

SEQ ID NO: 860 - protein, 6 aa, Artificial Sequence
  chemically synthesized
SSYWMS

SEQ ID NO: 861 - protein, 17 aa, Artificial Sequence
  chemically synthesized
WISAYNGNTNYAQKLQG

SEQ ID NO: 862 - protein, 17 aa, Artificial Sequence
  chemically synthesized
IINPRGATISYAQKFQG

SEQ ID NO: 863 - protein, 16 aa, Artificial Sequence
  chemically synthesized
YIYYNGNTYYNPSLRS

SEQ ID NO: 864 - protein, 17 aa, Artificial Sequence
  chemically synthesized
AISGSGGSTYYADSVKG

SEQ ID NO: 865 - protein, 10 aa, Artificial Sequence
  chemically synthesized
DADYSSGSGY

SEQ ID NO: 866 - protein, 10 aa, Artificial Sequence
  chemically synthesized
AGIYGFDFDY

SEQ ID NO: 867 - protein, 17 aa, Artificial Sequence
  chemically synthesized
ASDYVWGGYRYMDAFDI

SEQ ID NO: 868 - protein, 9 aa, Artificial Sequence
  chemically synthesized
ENWGSYFDL

SEQ ID NO: 869 - protein, 11 aa, Artificial Sequence
  chemically synthesized
SGDALPKQYAY

SEQ ID NO: 870 - protein, 14 aa, Artificial Sequence
  chemically synthesized
TGTSNDVGGYNYVS

SEQ ID NO: 871 - protein, 13 aa, Artificial Sequence
  chemically synthesized
SGSNSNIGSNSVN

SEQ ID NO: 872 - protein, 7 aa, Artificial Sequence
  chemically synthesized
KDTERPS

SEQ ID NO: 873 - protein, 7 aa, Artificial Sequence
  chemically synthesized
DVTNRPS

SEQ ID NO: 874 - protein, 7 aa, Artificial Sequence
  chemically synthesized
GNNQRPS

SEQ ID NO: 875 - protein, 7 aa, Artificial Sequence
  chemically synthesized
KASTLES

SEQ ID NO: 876 - protein, 11 aa, Artificial Sequence
  chemically synthesized
QSADNSITYRV

SEQ ID NO: 877 - protein, 12 aa, Artificial Sequence
  chemically synthesized
SSYTIVTNFEVL

SEQ ID NO: 878 - protein, 11 aa, Artificial Sequence
  chemically synthesized
AAWDDSLNGPV

SEQ ID NO: 879 - protein, 9 aa, Artificial Sequence
  chemically synthesized
QQSYSTPWT

SEQ ID NO: 880 - protein, 5 aa, Artificial Sequence
  chemically synthesized
SSWIH

SEQ ID NO: 881 - protein, 17 aa, Artificial Sequence
  chemically synthesized
YIYPSTGFTEYNQKFKD

SEQ ID NO: 882 - protein, 12 aa, Artificial Sequence
  chemically synthesized
WRDSSGYHAMDY

SEQ ID NO: 883 - protein, 15 aa, Artificial Sequence
  chemically synthesized
RASQSVSTSGYSYMH

SEQ ID NO: 884 - protein, 7 aa, Artificial Sequence
  chemically synthesized
FGSNLES

SEQ ID NO: 885 - protein, 9 aa, Artificial Sequence
  chemically synthesized
QHSWEIPYT

SEQ ID NO: 886 - protein, 12 aa, Artificial Sequence
  chemically synthesized
GFTFSSYDYYMH

SEQ ID NO: 887 - protein, 17 aa, Artificial Sequence
  chemically synthesized
VIWYSGSNTYYNDSLKS

SEQ ID NO: 888 - protein, 7 aa, Artificial Sequence
  chemically synthesized
AYFGVDV

SEQ ID NO: 889 - protein, 11 aa, Artificial Sequence
  chemically synthesized
RASQGIGNTLA

SEQ ID NO: 890 - protein, 17 aa, Artificial Sequence
  chemically synthesized
GINPSNGGTNYNEKFKN

SEQ ID NO: 891 - protein, 9 aa, Artificial Sequence
  chemically synthesized
QQYDHVPLT

SEQ ID NO: 892 - protein, 10 aa, Artificial Sequence
  chemically synthesized
GFSLTSYGVH

SEQ ID NO: 893 - protein, 16 aa, Artificial Sequence
  chemically synthesized
VIWAGGSTNYNPSLKS

SEQ ID NO: 894 - protein, 16 aa, Artificial Sequence
  chemically synthesized
VIYAGGSTNYNPSLKS

SEQ ID NO: 895 - protein, 9 aa, Artificial Sequence
  chemically synthesized
HQAYSSPYT

SEQ ID NO: 896 - protein, 10 aa, Artificial Sequence
  chemically synthesized
GFSLTSYGVH

SEQ ID NO: 897 - protein, 12 aa, Artificial Sequence
  chemically synthesized
ARAYGNYWYIDV

SEQ ID NO: 898 - protein, 11 aa, Artificial Sequence
  chemically synthesized
KASQSVSNDVA

SEQ ID NO: 899 - protein, 11 aa, Artificial Sequence
  chemically synthesized
KSSESVSNDVA

SEQ ID NO: 900 - protein, 7 aa, Artificial Sequence
  chemically synthesized
YAFHRFT

SEQ ID NO: 901 - protein, 5 aa, Artificial Sequence
  chemically synthesized
DYEMH

SEQ ID NO: 902 - protein, 17 aa, Artificial Sequence
  chemically synthesized
VIESETGGTAYNQKFKG

SEQ ID NO: 903 - protein, 16 aa, Artificial Sequence
  chemically synthesized
EGITTVATTYYWYFDV

SEQ ID NO: 904 - protein, 16 aa, Artificial Sequence
  chemically synthesized
RSSQSIVHSNGNTYLE

SEQ ID NO: 905 - protein, 7 aa, Artificial Sequence
  chemically synthesized
KVSNRFS

SEQ ID NO: 906 - protein, 9 aa, Artificial Sequence
  chemically synthesized
FQGSHVPLT

SEQ ID NO: 907 - protein, 10 aa, Artificial Sequence
  chemically synthesized
GYTFTTYPIE

SEQ ID NO: 908 - protein, 16 aa, Artificial Sequence
  chemically synthesized
NFHPYNDDTKYNEKFK

SEQ ID NO: 909 - protein, 12 aa, Artificial Sequence
  chemically synthesized
RASSSVISSYLH

SEQ ID NO: 910 - protein, 7 aa, Artificial Sequence
  chemically synthesized
STSNLAS

SEQ ID NO: 911 - protein, 9 aa, Artificial Sequence
  chemically synthesized
QQYNGYPLT

SEQ ID NO: 912 - protein, 9 aa, Artificial Sequence
  chemically synthesized
QQYNSYPLT

SEQ ID NO: 913 - protein, 6 aa, Artificial Sequence
  chemically synthesized
QGQSGQ

SEQ ID NO: 914 - protein, 5 aa, Artificial Sequence
  chemically synthesized
QGQSG

SEQ ID NO: 915 - protein, 4 aa, Artificial Sequence
  chemically synthesized
QGQS

SEQ ID NO: 916 - protein, 3 aa, Artificial Sequence
  chemically synthesized
QGQ

SEQ ID NO: 917 - protein, 2 aa, Artificial Sequence
  chemically synthesized
QG

SEQ ID NO: 918 - DNA, 21 bp, Artificial Sequence
  chemically synthesized
caaggccagtctggccaaggt

SEQ ID NO: 919 - protein, 151 aa, Artificial Sequence
  chemically synthesized
AMSGCSWSAFCPYLAGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 920 - DNA, 453 bp, Artificial Sequence
  chemically synthesized
gcgatgagtgggtgctcgtggtctgctttttgcccgtatttggcgggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 921 - protein, 151 aa, Artificial Sequence
  chemically synthesized
DVNCAIWYSVCTTVPGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 922 - DNA, 453 bp, Artificial Sequence
  chemically synthesized
gatgttaattgcgctatttggtattcggtgtgcactactgttcctggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 923 - protein, 151 aa, Artificial Sequence
  chemically synthesized
LVCPLYALSSGVCMGGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 924 - DNA, 453 bp, Artificial Sequence
  chemically synthesized
ttggtttgccctttgtatgcattgagttctggggtgtgcatggggggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 925 - protein, 151 aa, Artificial Sequence
  chemically synthesized
ETCNQYERSSGLCFAGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 926 - DNA, 453 bp, Artificial Sequence
  chemically synthesized
gagacttgcaatcagtatgagaggtcgagtggtttgtgctttgcgggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 927 - protein, 151 aa, Artificial Sequence
  chemically synthesized
APRTCYTYQCSSFYTGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 928 - DNA, 453 bp, Artificial Sequence
  chemically synthesized
gcgccgcggacgtgctatacgtatcagtgctctagtttttatactggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 929 - protein, 151 aa, Artificial Sequence
  chemically synthesized
GLCSWYLSSSGLCVDGGGSSGGSISSGLLSGRSDNHGGGSDIQLTQSPSSLSASVGDRVTITCRASESVDSYGISFMNWFQQKPGKAPKLLIYAASNQGSGVPSRFSGSGSGTDFTLTISSMQPEDFATYYCQQSKDVPWTFGQGTKLEIK

SEQ ID NO: 930 - DNA, 453 bp, Artificial Sequence
  chemically synthesized
ggtctttgcagttggtatcttagtagttcgggtttgtgcgtggatggaggtggctcgagcggcggctctatctcttccggactgctgtccggcagatccgacaatcacggcggaggatccgacatccagctgacccagagccctagcagcctgtctgccagcgtgggcgacagagtgaccatcacctgtagagccagcgagagcgtggacagttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 931 - protein, 151 aa, Artificial Sequence
  chemically synthesized
AMSGCSWSAFCPYLAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 932 - DNA, 453 bp, Artificial Sequence
  chemically synthesized
gcgatgagtgggtgctcgtggtctgctttttgcccgtatttggcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 933 - protein, 151 aa, Artificial Sequence
  chemically synthesized
DVNCAIWYSVCTTVPGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 934 - DNA, 453 bp, Artificial Sequence
  chemically synthesized
gatgttaattgcgctatttggtattcggtgtgcactactgttcctggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 935 - protein, 151 aa, Artificial Sequence
  chemically synthesized
LVCPLYALSSGVCMGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 936 - DNA, 453 bp, Artificial Sequence
  chemically synthesized
ttggtttgccctttgtatgcattgagttctggggtgtgcatggggggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 937 - protein, 151 aa, Artificial Sequence
  chemically synthesized
SVNCRIWSAVCAGYEGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 938 - DNA, 453 bp, Artificial Sequence
  chemically synthesized
tctgtgaattgccggatttggtcggctgtttgcgcggggtatgagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 939 - protein, 151 aa, Artificial Sequence
  chemically synthesized
MLVCSLQPTAMCERVGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 940 - DNA, 453 bp, Artificial Sequence
  chemically synthesized
atgcttgtgtgctcgttgcagcctactgcgatgtgcgagcgggtgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 941 - protein, 151 aa, Artificial Sequence
  chemically synthesized
APRCYMFASYCKSQYGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 942 - DNA, 453 bp, Artificial Sequence
  chemically synthesized
gcgcctaggtgctatatgtttgcgtcgtattgcaagagtcagtatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 943 - protein, 151 aa, Artificial Sequence
  chemically synthesized
VGPCELTPKPVCNTYGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 944 - DNA, 453 bp, Artificial Sequence
  chemically synthesized
gtggggccttgcgagttgacgccgaagcctgtttgcaatacgtatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 945 - protein, 151 aa, Artificial Sequence
  chemically synthesized
ETCNQYERSSGLCFAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 946 - DNA, 453 bp, Artificial Sequence
  chemically synthesized
gagacttgcaatcagtatgagaggtcgagtggtttgtgctttgcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 947 - protein, 151 aa, Artificial Sequence
  chemically synthesized
APRTCYTYQCSSFYTGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 948 - DNA, 453 bp, Artificial Sequence
  chemically synthesized
gcgccgcggacgtgctatacgtatcagtgctctagtttttatactggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 949 - protein, 151 aa, Artificial Sequence
  chemically synthesized
GLCSWYLSSSGLCVDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 950 - DNA, 453 bp, Artificial Sequence
  chemically synthesized
ggtctttgcagttggtatcttagtagttcgggtttgtgcgtggatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 951 - protein, 151 aa, Artificial Sequence
  chemically synthesized
VPWCQLTPRVMCMWAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 952 - DNA, 453 bp, Artificial Sequence
  chemically synthesized
gtgccttggtgccagttgacgccgcgggttatgtgcatgtgggcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 953 - protein, 151 aa, Artificial Sequence
  chemically synthesized
NWLDCQFYSECSVYGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 954 - DNA, 453 bp, Artificial Sequence
  chemically synthesized
aattggttggattgccagttttattctgagtgctctgtttatggtggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 955 - protein, 151 aa, Artificial Sequence
  chemically synthesized
SCPLYVMSSFGGCWDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 956 - DNA, 453 bp, Artificial Sequence
  chemically synthesized
tcgtgccctttgtatgtgatgtctagttttggtgggtgctgggatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 957 - protein, 151 aa, Artificial Sequence
  chemically synthesized
MSHCWMFSSSCDGVKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 958 - DNA, 453 bp, Artificial Sequence
  chemically synthesized
atgagtcattgctggatgttttcgagttcttgcgatggggtgaagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 959 - protein, 151 aa, Artificial Sequence
  chemically synthesized
VSYCTWLIEVTCLRGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 960 - DNA, 453 bp, Artificial Sequence
  chemically synthesized
gtttcgtattgcacgtggttgattgaggtgacttgcctgaggggtggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 961 - protein, 151 aa, Artificial Sequence
  chemically synthesized
VLCAAYALSSGICGGGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 962 - DNA, 453 bp, Artificial Sequence
  chemically synthesized
gttttgtgcgctgcttatgctttgagttcgggtatttgcggtgggggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 963 - protein, 151 aa, Artificial Sequence
  chemically synthesized
TTCNLYQQSSMFCNAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 964 - DNA, 453 bp, Artificial Sequence
  chemically synthesized
acgacttgcaatctgtatcagcagtcttctatgttttgcaatgctggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 965 - protein, 151 aa, Artificial Sequence; identical to SEQ ID NO: 941
  chemically synthesized

SEQ ID NO: 966 - DNA, 453 bp, Artificial Sequence; identical to SEQ ID NO: 942
  chemically synthesized

SEQ ID NO: 967 - protein, 151 aa, Artificial Sequence
  chemically synthesized
PCDQNPYFYPYVCHAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 968 - DNA, 453 bp, Artificial Sequence
  chemically synthesized
ccttgcgatcagaatccgtatttttatccgtatgtgtgccatgcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 969 - protein, 151 aa, Artificial Sequence
  chemically synthesized
SVCPMYALSSMLCGAGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 970 - DNA, 453 bp, Artificial Sequence
  chemically synthesized
tctgtgtgccctatgtatgcgttgagttctatgttgtgcggtgcgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 971 - protein, 151 aa, Artificial Sequence
  chemically synthesized
LSVECYVFSRCSSLPGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 972 - DNA, 453 bp, Artificial Sequence
  chemically synthesized
ttgtctgtggagtgctatgtgttttcgcggtgcagtagtctgccgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 973 - protein, 150 aa, Artificial Sequence
  chemically synthesized
FYCTYLVSLTCHPQGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 974 - DNA, 450 bp, Artificial Sequence
  chemically synthesized
ttttattgcacttatttggtgtctttgacttgccatccgcagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 975 - protein, 151 aa, Artificial Sequence
  chemically synthesized
SMAGCQWSSFCVQRDGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 976 - DNA, 453 bp, Artificial Sequence
  chemically synthesized
tctatggcgggttgccagtggagttcgttttgcgtgcagcgggatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 977 - protein, 151 aa, Artificial Sequence
  chemically synthesized
IYSCYMFASRCTSDKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 978 - DNA, 453 bp, Artificial Sequence
  chemically synthesized
atttattcgtgctatatgtttgcttcgcggtgcacgtctgataagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 979 - protein, 154 aa, Artificial Sequence
  chemically synthesized
DVNCAIWYSVCTTVPGGGSSGGAVGLLAPPGGLSGRSDNHGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 980 - DNA, 558 bp, Artificial Sequence
  chemically synthesized
caaggccagtctggccaaggtgatgttaattgcgctatttggtattcggtgtgcactactgttcctggaggtggctcgagcggcggctctatctcttccggactgctgtccggcagatccgacaatcacggcggaggatccggaggtggctcgagcggcggcgctgtgggactgctggctcctcctggtggcctgtctggcagatctgataaccacggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 981 - protein, 154 aa, Artificial Sequence
  chemically synthesized
NWLDCQFYSECSVYGGGGSSGGAVGLLAPPGGLSGRSDNHGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 982 - DNA, 537 bp, Artificial Sequence
  chemically synthesized
aattggttggattgccagttttattctgagtgctctgtttatggtggaggtggctcgagcggcggctctatctcttccggactgctgtccggcagatccgacaatcacggcggaggatccggaggtggctcgagcggcggcgctgtgggactgctggctcctcctggtggcctgtctggcagatctgataaccacggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 983 - protein, 154 aa, Artificial Sequence
  chemically synthesized
VLCAAYALSSGICGGGGGSSGGAVGLLAPPGGLSGRSDNHGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 984 - DNA, 537 bp, Artificial Sequence
  chemically synthesized
gttttgtgcgctgcttatgctttgagttcgggtatttgcggtgggggaggtggctcgagcggcggctctatctcttccggactgctgtccggcagatccgacaatcacggcggaggatccggaggtggctcgagcggcggcgctgtgggactgctggctcctcctggtggcctgtctggcagatctgataaccacggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 985 - protein, 151 aa, Artificial Sequence
  chemically synthesized
SRCSVYEVSSGLCDWGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 986 - DNA, 453 bp, Artificial Sequence
  chemically synthesized
tctcgttgctctgtgtatgaggtttcgtcggggctgtgcgattggggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 987 - protein, 151 aa, Artificial Sequence
  chemically synthesized
GMCSAYAYSSKLCTIGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 988 - DNA, 453 bp, Artificial Sequence
  chemically synthesized
gggatgtgctcggcgtatgcttattcgagtaagttgtgcactattggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 989 - protein, 151 aa, Artificial Sequence
  chemically synthesized
MTTNTCNLLCQQFLTGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 990 - DNA, 453 bp, Artificial Sequence
  chemically synthesized
atgactacgaatacttgcaatctgttgtgccagcagtttttgacgggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 991 - protein, 151 aa, Artificial Sequence
  chemically synthesized
FQPCLMFASSCFTSKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 992 - DNA, 453 bp, Artificial Sequence
  chemically synthesized
tttcagccgtgcctgatgtttgcgagtagttgctttactagtaagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 993 - protein, 151 aa, Artificial Sequence
  chemically synthesized
ALCSMYLASSGLCNKGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 994 - DNA, 453 bp, Artificial Sequence
  chemically synthesized
gcgctttgcagtatgtatcttgctagttctgggctgtgcaataagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 995 - protein, 151 aa, Artificial Sequence
  chemically synthesized
EFCARDWLPYQCSSFGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 996 - DNA, 453 bp, Artificial Sequence
  chemically synthesized
gagttttgcgctcgggattggctgccgtatcagtgctcgagttttggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 997 - protein, 151 aa, Artificial Sequence
  chemically synthesized
PYICSSFPLDCQAGQGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 998 - DNA, 453 bp, Artificial Sequence
  chemically synthesized
ccttatatttgctctagttttccgttggattgccaggcgggtcagggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 999 - protein, 149 aa, Artificial Sequence
  chemically synthesized
DYTYCRWVNWCLSGVGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1000 - DNA, 446 bp, Artificial Sequence
  chemically synthesized
gattatacgtattgccgttgggttaattggtgcttgtctggggtgggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtcct

SEQ ID NO: 1001 - protein, 149 aa, Artificial Sequence
  chemically synthesized
ILCPEDPWGHKCKLPGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1002 - DNA, 447 bp, Artificial Sequence
  chemically synthesized
attctgtgcccggaggatccgtgggggcataagtgcaagctgcctggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1003 - protein, 149 aa, Artificial Sequence
  chemically synthesized
TNIWSCQTYCDHKHKGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1004 - DNA, 447 bp, Artificial Sequence
  chemically synthesized
acgaatatttggagttgccagacttattgcgatcataagcataagggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1005 - protein, 149 aa, Artificial Sequence
  chemically synthesized
SDHKCKLQNCMNTKVGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1006 - DNA, 447 bp, Artificial Sequence
  chemically synthesized
agtgatcataagtgcaagcttcagaattgcatgaatactaaggttggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1007 - protein, 149 aa, Artificial Sequence
  chemically synthesized
PGNCHPMQKEMCQFIGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1008 - DNA, 447 bp, Artificial Sequence
  chemically synthesized
cctggtaattgccatcctatgcagaaggagatgtgccagtttattggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1009 - protein, 149 aa, Artificial Sequence
  chemically synthesized
VEHLCYTHNKCKHPDGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1010 - DNA, 447 bp, Artificial Sequence
  chemically synthesized
gttgagcatttgtgctatacgcataataagtgcaagcatcctgatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1011 - protein, 149 aa, Artificial Sequence
  chemically synthesized
TIPRCGQHPKCKDTLGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1012 - DNA, 447 bp, Artificial Sequence
  chemically synthesized
actattccgaggtgcggtcagcatccgaagtgcaaggatactttgggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1013 - protein, 149 aa, Artificial Sequence
  chemically synthesized
ACRICQDHPKTKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1014 - DNA, 447 bp, Artificial Sequence
  chemically synthesized
gcgtgccgtatttgtcaggatcatcctaagacgaagtggaattctggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1015 - protein, 149 aa, Artificial Sequence
  chemically synthesized
LIQCTGNLDHKCKHYGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1016 - DNA, 446 bp, Artificial Sequence
  chemically synthesized
cttattcagtgcactggtaatcttgatcataagtgcaagcattatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtcct

SEQ ID NO: 1017 - protein, 149 aa, Artificial Sequence
  chemically synthesized
IPCHHSADHKHKCTSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1018 - DNA, 447 bp, Artificial Sequence
  chemically synthesized
attccttgccatcatagtgctgatcataagcataagtgcacgagtggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1019 - protein, 149 aa, Artificial Sequence
  chemically synthesized
SRQICADYNCHNKYKGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1020 - DNA, 447 bp, Artificial Sequence
  chemically synthesized
tcgcggcagatttgcgctgattataattgccataataagtataagggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1021 - protein, 149 aa, Artificial Sequence
  chemically synthesized
QPCNPQIDHKIKCIYGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1022 - DNA, 447 bp, Artificial Sequence
  chemically synthesized
cagccttgcaatccgcagattgatcataagattaagtgcatttatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1023 - protein, 149 aa, Artificial Sequence
  chemically synthesized
HYTICMTHNKCKDMAGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1024 - DNA, 447 bp, Artificial Sequence
  chemically synthesized
cattatactatttgcatgacgcataataagtgcaaggatatggcgggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1025 - protein, 149 aa, Artificial Sequence
  chemically synthesized
ANSCLAVEHKCKHNYGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1026 - DNA, 447 bp, Artificial Sequence
  chemically synthesized
gctaatagttgccttgctgttgagcataagtgcaagcataattatggaggtggctcgagcggcggctctatctcttccggactgctgtccggcagatccgacaatcacggcggaggctcttatgagctgactcagccaccttcagcatcagtcaatgtaggagagactgtcaaaatcacctgctctggggaccaattgccgaaatattttgcagattggtttcatcaaaggtcagaccagaccattttgcaagtgatatatgatgataataagcgcccctcgggtatccctgaaagaatctctgggtccagctcagggacaacagccaccttgaccatcagagatgtccgggctgaggatgaaggtgactattactgtttctcaggatatgttgatagtgatagcaaattgtatgtttttggcagcggaacccagctcaccgtccta

SEQ ID NO: 1027 - protein, 145 aa, Artificial Sequence
  chemically synthesized
HPLQKELAQFIGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1028 - protein, 151 aa, Artificial Sequence
  chemically synthesized
TSYCSIEHYPCNTHHGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1029 - protein, 158 aa, Artificial Sequence
  chemically synthesized
QGQSGQGTSYCSIEHYPCNTHHGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1030 - DNA, 453 bp, Artificial Sequence
  chemically synthesized
acgtcatactgcagtattgagcattacccctgcaatacacatcatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1031 - DNA, 474 bp, Artificial Sequence
  chemically synthesized
caaggccagtctggccaaggtacgtcatactgcagtattgagcattacccctgcaatacacatcatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1032 - protein, 149 aa, Artificial Sequence
  chemically synthesized
ACRICQDHPATKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1033 - DNA, 761 bp, Artificial Sequence
  chemically synthesized
gcgtgccgtatttgtcaggatcatcctgcgacgaagtggaattctggaggtggctcgagcggcggctctatctcttccggactgctgtccggcagatccgacaatcacggcggaggctctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 1034 - protein, 143 aa, Artificial Sequence
  chemically synthesized
DAPKTKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1035 - DNA, 744 bp, Artificial Sequence
  chemically synthesized
gatgctcctaagacgaagtggaattctggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 1036 - protein, 143 aa, Artificial Sequence
  chemically synthesized
DAPATKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1037 - DNA, 744 bp, Artificial Sequence
  chemically synthesized
gatgctcctgcgacgaagtggaattctggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 1038 - DNA, 750 bp, Artificial Sequence
  chemically synthesized
catcctctgcagaaggagctggcccagtttattggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 1039 - protein, 142 aa, Artificial Sequence
  chemically synthesized
HPQSKDTLGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1040 - protein, 7 aa, Artificial Sequence
  chemically synthesized
GGGSSGG

SEQ ID NO: 1041 - protein, 151 aa, Artificial Sequence; identical to SEQ ID NO: 919
  chemically synthesized

SEQ ID NO: 1042 - protein, 151 aa, Artificial Sequence; identical to SEQ ID NO: 921
  chemically synthesized

SEQ ID NO: 1043 - protein, 151 aa, Artificial Sequence; identical to SEQ ID NO: 923
  chemically synthesized

SEQ ID NO: 1044 - protein, 151 aa, Artificial Sequence; identical to SEQ ID NO: 925
  chemically synthesized

SEQ ID NO: 1045 - protein, 151 aa, Artificial Sequence; identical to SEQ ID NO: 927
  chemically synthesized

SEQ ID NO: 1046 - protein, 151 aa, Artificial Sequence; identical to SEQ ID NO: 929
  chemically synthesized

SEQ ID NO: 1047 - protein, 151 aa, Artificial Sequence; identical to SEQ ID NO: 931
  chemically synthesized

SEQ ID NO: 1048 - protein, 151 aa, Artificial Sequence; identical to SEQ ID NO: 933
  chemically synthesized

SEQ ID NO: 1049 - protein, 151 aa, Artificial Sequence; identical to SEQ ID NO: 935
  chemically synthesized

SEQ ID NO: 1050 - protein, 151 aa, Artificial Sequence; identical to SEQ ID NO: 937
  chemically synthesized

SEQ ID NO: 1051 - protein, 151 aa, Artificial Sequence; identical to SEQ ID NO: 939
  chemically synthesized

SEQ ID NO: 1052 - protein, 151 aa, Artificial Sequence; identical to SEQ ID NO: 943
  chemically synthesized

SEQ ID NO: 1053 - protein, 151 aa, Artificial Sequence; identical to SEQ ID NO: 945
  chemically synthesized

SEQ ID NO: 1054 - protein, 151 aa, Artificial Sequence; identical to SEQ ID NO: 947
  chemically synthesized

SEQ ID NO: 1055 - protein, 151 aa, Artificial Sequence; identical to SEQ ID NO: 949
  chemically synthesized

SEQ ID NO: 1056 - protein, 151 aa, Artificial Sequence; identical to SEQ ID NO: 951
  chemically synthesized

SEQ ID NO: 1057 - protein, 151 aa, Artificial Sequence; identical to SEQ ID NO: 955
  chemically synthesized

SEQ ID NO: 1058 - protein, 151 aa, Artificial Sequence; identical to SEQ ID NO: 957
  chemically synthesized

SEQ ID NO: 1059 - protein, 151 aa, Artificial Sequence; identical to SEQ ID NO: 959
  chemically synthesized

SEQ ID NO: 1060 - protein, 151 aa, Artificial Sequence; identical to SEQ ID NO: 961
  chemically synthesized

SEQ ID NO: 1061 - protein, 151 aa, Artificial Sequence; identical to SEQ ID NO: 963
  chemically synthesized

SEQ ID NO: 1062 - protein, 151 aa, Artificial Sequence; identical to SEQ ID NO: 941
  chemically synthesized

SEQ ID NO: 1063 - protein, 151 aa, Artificial Sequence; identical to SEQ ID NO: 969
  chemically synthesized

SEQ ID NO: 1064 - protein, 151 aa, Artificial Sequence; identical to SEQ ID NO: 971
  chemically synthesized

SEQ ID NO: 1065 - protein, 150 aa, Artificial Sequence; identical to SEQ ID NO: 973
  chemically synthesized

SEQ ID NO: 1066 - protein, 151 aa, Artificial Sequence; identical to SEQ ID NO: 975
  chemically synthesized

SEQ ID NO: 1067 - protein, 151 aa, Artificial Sequence; identical to SEQ ID NO: 977
  chemically synthesized

SEQ ID NO: 1068 - protein, 154 aa, Artificial Sequence; identical to SEQ ID NO: 979
  chemically synthesized

SEQ ID NO: 1069 - protein, 154 aa, Artificial Sequence; identical to SEQ ID NO: 981
  chemically synthesized

SEQ ID NO: 1070 - protein, 154 aa, Artificial Sequence; identical to SEQ ID NO: 983
  chemically synthesized

SEQ ID NO: 1071 - protein, 151 aa, Artificial Sequence; identical to SEQ ID NO: 985
  chemically synthesized

SEQ ID NO: 1072 - protein, 151 aa, Artificial Sequence; identical to SEQ ID NO: 987
  chemically synthesized

SEQ ID NO: 1073 - protein, 151 aa, Artificial Sequence; identical to SEQ ID NO: 989
  chemically synthesized

SEQ ID NO: 1074 - protein, 151 aa, Artificial Sequence; identical to SEQ ID NO: 993
  chemically synthesized

SEQ ID NO: 1075 - protein, 151 aa, Artificial Sequence; identical to SEQ ID NO: 995
  chemically synthesized

SEQ ID NO: 1076 - protein, 151 aa, Artificial Sequence; identical to SEQ ID NO: 997
  chemically synthesized

SEQ ID NO: 1077 - protein, 149 aa, Artificial Sequence; identical to SEQ ID NO: 999
  chemically synthesized

SEQ ID NO: 1078 - protein, 149 aa, Artificial Sequence; identical to SEQ ID NO: 1001
  chemically synthesized

SEQ ID NO: 1079 - protein, 149 aa, Artificial Sequence; identical to SEQ ID NO: 1003
  chemically synthesized

SEQ ID NO: 1080 - protein, 149 aa, Artificial Sequence; identical to SEQ ID NO: 1005
  chemically synthesized

SEQ ID NO: 1081 - protein, 149 aa, Artificial Sequence; identical to SEQ ID NO: 1007
  chemically synthesized

SEQ ID NO: 1082 - protein, 149 aa, Artificial Sequence; identical to SEQ ID NO: 1009
  chemically synthesized

SEQ ID NO: 1083 - protein, 149 aa, Artificial Sequence; identical to SEQ ID NO: 1011
  chemically synthesized

SEQ ID NO: 1084 - protein, 149 aa, Artificial Sequence; identical to SEQ ID NO: 1013
  chemically synthesized

SEQ ID NO: 1085 - protein, 149 aa, Artificial Sequence; identical to SEQ ID NO: 1015
  chemically synthesized

SEQ ID NO: 1086 - protein, 149 aa, Artificial Sequence; identical to SEQ ID NO: 1017
  chemically synthesized

SEQ ID NO: 1087 - protein, 149 aa, Artificial Sequence; identical to SEQ ID NO: 1019
  chemically synthesized

SEQ ID NO: 1088 - protein, 149 aa, Artificial Sequence; identical to SEQ ID NO: 1021
  chemically synthesized

SEQ ID NO: 1089 - protein, 149 aa, Artificial Sequence; identical to SEQ ID NO: 1023
  chemically synthesized

SEQ ID NO: 1090 - protein, 149 aa, Artificial Sequence; identical to SEQ ID NO: 1025
  chemically synthesized

SEQ ID NO: 1091 - protein, 20 aa, Artificial Sequence
  chemically synthesized
ISSGLLSSGGSGGSLSGRNH

SEQ ID NO: 1092 - protein, 15 aa, Artificial Sequence
  chemically synthesized
ISSGLLSGRSANPRG

SEQ ID NO: 1093 - protein, 18 aa, Artificial Sequence
  chemically synthesized
AVGLLAPPTSGRSANPRG

SEQ ID NO: 1094 - protein, 17 aa, Artificial Sequence
  chemically synthesized
AVGLLAPPSGRSANPRG

SEQ ID NO: 1095 - protein, 13 aa, Artificial Sequence
  chemically synthesized
ISSGLLSGRSDDH

SEQ ID NO: 1096 - protein, 13 aa, Artificial Sequence
  chemically synthesized
ISSGLLSGRSDIH

SEQ ID NO: 1097 - protein, 13 aa, Artificial Sequence
  chemically synthesized
ISSGLLSGRSDQH

SEQ ID NO: 1098 - protein, 13 aa, Artificial Sequence
  chemically synthesized
ISSGLLSGRSDTH

SEQ ID NO: 1099 - protein, 13 aa, Artificial Sequence
  chemically synthesized
ISSGLLSGRSDYH

SEQ ID NO: 1100 - protein, 13 aa, Artificial Sequence
  chemically synthesized
ISSGLLSGRSDNP

SEQ ID NO: 1101 - protein, 13 aa, Artificial Sequence
  chemically synthesized
ISSGLLSGRSANP

SEQ ID NO: 1102 - protein, 13 aa, Artificial Sequence
  chemically synthesized
ISSGLLSGRSANI

SEQ ID NO: 1103 - protein, 18 aa, Artificial Sequence
  chemically synthesized
AVGLLAPPGGLSGRSDDH

SEQ ID NO: 1104 - protein, 18 aa, Artificial Sequence
  chemically synthesized
AVGLLAPPGGLSGRSDIH

SEQ ID NO: 1105 - protein, 18 aa, Artificial Sequence
  chemically synthesized
AVGLLAPPGGLSGRSDQH

SEQ ID NO: 1106 - protein, 18 aa, Artificial Sequence
  chemically synthesized
AVGLLAPPGGLSGRSDTH

SEQ ID NO: 1107 - protein, 18 aa, Artificial Sequence
  chemically synthesized
AVGLLAPPGGLSGRSDYH

SEQ ID NO: 1108 - protein, 18 aa, Artificial Sequence
  chemically synthesized
AVGLLAPPGGLSGRSDNP

SEQ ID NO: 1109 - protein, 18 aa, Artificial Sequence
  chemically synthesized
AVGLLAPPGGLSGRSANP

SEQ ID NO: 1110 - protein, 18 aa, Artificial Sequence
  chemically synthesized
AVGLLAPPGGLSGRSANI

SEQ ID NO: 1111 - protein, 13 aa, Artificial Sequence
  chemically synthesized
ISSGLLSGRSDNI

SEQ ID NO: 1112 - protein, 18 aa, Artificial Sequence
  chemically synthesized
AVGLLAPPGGLSGRSDNI

SEQ ID NO: 1113 - protein, 145 aa, Artificial Sequence; identical to SEQ ID NO: 1027
  chemically synthesized

SEQ ID NO: 1114 - protein, 142 aa, Artificial Sequence; identical to SEQ ID NO: 1039
  chemically synthesized

SEQ ID NO: 1115 - protein, 142 aa, Artificial Sequence
  chemically synthesized
HPASKDTLGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1116 - protein, 149 aa, Artificial Sequence; identical to SEQ ID NO: 1032
  chemically synthesized

SEQ ID NO: 1117 - protein, 143 aa, Artificial Sequence; identical to SEQ ID NO: 1034
  chemically synthesized

SEQ ID NO: 1118 - protein, 143 aa, Artificial Sequence; identical to SEQ ID NO: 1036
  chemically synthesized

SEQ ID NO: 1119 - protein, 150 aa, Artificial Sequence
  chemically synthesized
ACRICQDHPATKWNSGGGSSGGSISSGLLSGRSANPRGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1120 - protein, 157 aa, Artificial Sequence
  chemically synthesized
QGQSGQGACRICQDHPATKWNSGGGSSGGSISSGLLSGRSANPRGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1121 - DNA, 450 bp, Artificial Sequence
  chemically synthesized
gcgtgccgtatttgtcaggatcatcctgcgacgaagtggaattctggaggtggctcgagcggcggctctatctcttccggactgctgtccggcagatccgccaatcctcgtggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1122 - DNA, 471 bp, Artificial Sequence
  chemically synthesized
caaggccagtctggccaaggtgcgtgccgtatttgtcaggatcatcctgcgacgaagtggaattctggaggtggctcgagcggcggctctatctcttccggactgctgtccggcagatccgccaatcctcgtggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1123 - protein, 151 aa, Artificial Sequence
  chemically synthesized
ACRICQDHPATKWNSGGGSSGGAVGLLAPPSGRSANPRGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1124 - protein, 158 aa, Artificial Sequence
  chemically synthesized
QGQSGQGACRICQDHPATKWNSGGGSSGGAVGLLAPPSGRSANPRGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1125 - DNA, 21 bp, Artificial Sequence
  chemically synthesized
caggggcaatctggccagggg

SEQ ID NO: 1126 - DNA, 21 bp, Artificial Sequence
  chemically synthesized
caaggccagtctggccaagga

SEQ ID NO: 1127 - protein, 149 aa, Artificial Sequence
  chemically synthesized
ACRICQDHPATKWNSGGGSSGGSISSGLLSGRSDGHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1128 - protein, 156 aa, Artificial Sequence
  chemically synthesized
QGQSGQGACRICQDHPATKWNSGGGSSGGSISSGLLSGRSDGHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1129 - DNA, 447 bp, Artificial Sequence
  chemically synthesized
gcgtgccgtatttgtcaggatcatcctgcgacgaagtggaattctggaggtggctcgagcggcggctctatctcttccggactgctgtccggcagatccgaccagcacggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1130 - DNA, 468 bp, Artificial Sequence
  chemically synthesized
caaggccagtctggccaaggtgcgtgccgtatttgtcaggatcatcctgcgacgaagtggaattctggaggtggctcgagcggcggctctatctcttccggactgctgtccggcagatccgaccagcacggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1131 - protein, 149 aa, Artificial Sequence
  chemically synthesized
ACRICQDHPATKWNSGGGSSGGSISSGLLSGRSANPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1132 - protein, 156 aa, Artificial Sequence
  chemically synthesized
QGQSGQGACRICQDHPATKWNSGGGSSGGSISSGLLSGRSANPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1133 - DNA, 468 bp, Artificial Sequence
  chemically synthesized
caaggccagtctggccaaggtgcgtgccgtatttgtcaggatcatcctgcgacgaagtggaattctggaggtggctcgagcggcggctctatctcttccggactgctgtccggcagatccgctaatcccggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1134 - protein, 149 aa, Artificial Sequence
  chemically synthesized
ACRICQDHPATKWNSGGGSSGGSISSGLLSGRSDNPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1135 - protein, 156 aa, Artificial Sequence
  chemically synthesized
QGQSGQGACRICQDHPATKWNSGGGSSGGSISSGLLSGRSDNPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVL

SEQ ID NO: 1136 - DNA, 447 bp, Artificial Sequence
  chemically synthesized
gcgtgccgtatttgtcaggatcatcctgcgacgaagtggaattctggaggtggctcgagcggcggctctatctcttccggactgctgtccggcagatccgacaatcccggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1137 - DNA, 468 bp, Artificial Sequence
  chemically synthesized
caaggccagtctggccaaggtgcgtgccgtatttgtcaggatcatcctgcgacgaagtggaattctggaggtggctcgagcggcggctctatctcttccggactgctgtccggcagatccgacaatcccggcggaggatcctacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctg

SEQ ID NO: 1138 - protein, 152 aa, Artificial Sequence
  chemically synthesized
AMSGCSWSAFCPYLAGGGSSGGSISSGLLSGRSANPRGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1139 - protein, 159 aa, Artificial Sequence
  chemically synthesized
QGQSGQGAMSGCSWSAFCPYLAGGGSSGGSISSGLLSGRSANPRGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1140 - protein, 10 aa, Artificial Sequence
  chemically synthesized
GDSISSTAYH

SEQ ID NO: 1141 - DNA, 456 bp, Artificial Sequence
  chemically synthesized
gcgatgagtgggtgctcgtggtctgctttttgcccgtatttggcgggaggtggctcgagcggcggctctatctcttccggactgctgtccggcagatccgccaatcctcgtggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1142 - DNA, 477 bp, Artificial Sequence
  chemically synthesized
caaggccagtctggccaaggtgcgatgagtgggtgctcgtggtctgctttttgcccgtatttggcgggaggtggctcgagcggcggctctatctcttccggactgctgtccggcagatccgccaatcctcgtggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1143 - protein, 157 aa, Artificial Sequence
  chemically synthesized
QGQSGQGAMSGCSWSAFCPYLGGGSSGGSISSGLLSGRSANPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1144 - protein, 150 aa, Artificial Sequence
  chemically synthesized
AMSGCSWSAFCPYLGGGSSGGSISSGLLSGRSANPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1145 - DNA, 453 bp, Artificial Sequence
  chemically synthesized
gcgatgagtgggtgctcgtggtctgctttttgcccgtatttggcgggaggtggctcgagcggcggctctatctcttccggactgctgtccggcagatccgctaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1146 - DNA, 474 bp, Artificial Sequence
  chemically synthesized
caaggccagtctggccaaggtgcgatgagtgggtgctcgtggtctgctttttgcccgtatttggcgggaggtggctcgagcggcggctctatctcttccggactgctgtccggcagatccgctaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1147 - protein, 157 aa, Artificial Sequence
  chemically synthesized
QGQSGQGAMSGCSWSAFCPYLGGGSSGGSISSGLLSGRSDNPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1148 - protein, 150 aa, Artificial Sequence
  chemically synthesized
AMSGCSWSAFCPYLGGGSSGGSISSGLLSGRSDNPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1149 - DNA, 453 bp, Artificial Sequence
  chemically synthesized
gcgatgagtgggtgctcgtggtctgctttttgcccgtatttggcgggaggtggctcgagcggcggctctatctcttccggactgctgtccggcagatccgacaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1150 - DNA, 474 bp, Artificial Sequence
  chemically synthesized
caaggccagtctggccaaggtgcgatgagtgggtgctcgtggtctgctttttgcccgtatttggcgggaggtggctcgagcggcggctctatctcttccggactgctgtccggcagatccgacaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1151 - protein, 158 aa, Artificial Sequence; identical to SEQ ID NO: 1029
  chemically synthesized

SEQ ID NO: 1152 - protein, 151 aa, Artificial Sequence; identical to SEQ ID NO: 1028
  chemically synthesized

SEQ ID NO: 1153 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1154 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgacaatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1155 - protein, 163 aa, Artificial Sequence
  chemically synthesized
QGQSGQGTSYCSIEHYPCNTHHGGGSSGGSAVGLLAPPGGLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1156 - protein, 156 aa, Artificial Sequence
  chemically synthesized
TSYCSIEHYPCNTHHGGGSSGGSAVGLLAPPGGLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1157 - protein, 8 aa, Artificial Sequence
  chemically synthesized
LSGRSGNH

SEQ ID NO: 1158 - protein, 9 aa, Artificial Sequence
  chemically synthesized
SGRSANPRG

SEQ ID NO: 1159 - protein, 162 aa, Artificial Sequence
  chemically synthesized
QGQSGQGTSYCSIEHYPCNTHHGGGSSGGSAVGLLAPPSGRSANPRGGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1160 - protein, 155 aa, Artificial Sequence
  chemically synthesized
TSYCSIEHYPCNTHHGGGSSGGSAVGLLAPPSGRSANPRGGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1161 - protein, 8 aa, Artificial Sequence
  chemically synthesized
LSGRSDDH

SEQ ID NO: 1162 - protein, 8 aa, Artificial Sequence
  chemically synthesized
LSGRSDIH

SEQ ID NO: 1163 - protein, 158 aa, Artificial Sequence
  chemically synthesized
QGQSGQGTSYCSIEHYPCNTHHGGGSSGGSISSGLLSGRSDYHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1164 - protein, 151 aa, Artificial Sequence
  chemically synthesized
TSYCSIEHYPCNTHHGGGSSGGSISSGLLSGRSDYHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1165 - protein, 8 aa, Artificial Sequence
  chemically synthesized
LSGRSDQH

SEQ ID NO: 1166 - protein, 8 aa, Artificial Sequence
  chemically synthesized
LSGRSDTH

SEQ ID NO: 1167 - protein, 158 aa, Artificial Sequence
  chemically synthesized
QGQSGQGTSYCSIEHYPCNTHHGGGSSGGSISSGLLSGRSDNIGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1168 - protein, 151 aa, Artificial Sequence
  chemically synthesized
TSYCSIEHYPCNTHHGGGSSGGSISSGLLSGRSDNIGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1169 - protein, 8 aa, Artificial Sequence
  chemically synthesized
LSGRSDYH

SEQ ID NO: 1170 - protein, 152 aa, Artificial Sequence
  chemically synthesized
TSYCSIEHYPCNTHHGGGSSGGSISSGLLSGRSANPRGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1171 - protein, 159 aa, Artificial Sequence
  chemically synthesized
QGQSGQGTSYCSIEHYPCNTHHGGGSSGGSISSGLLSGRSANPRGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1172 - DNA, 456 bp, Artificial Sequence
  chemically synthesized
acgtcttactgcagtattgagcattacccctgcaatacacatcatggaggtggctcgagcggcggctctatctcttccggactgctgtccggcagatccgccaatcctcgtggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1173 - DNA, 477 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgccaatcctcgtggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1174 - protein, 151 aa, Artificial Sequence
  chemically synthesized
TSYCSIEHYPCNTHHGGGSSGGSISSGLLSGRSDDHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1175 - protein, 158 aa, Artificial Sequence
  chemically synthesized
QGQSGQGTSYCSIEHYPCNTHHGGGSSGGSISSGLLSGRSDDHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1176 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgacgatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1177 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgacgatcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1178 - protein, 151 aa, Artificial Sequence
  chemically synthesized
TSYCSIEHYPCNTHHGGGSSGGSISSGLLSGRSDIHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1179 - protein, 158 aa, Artificial Sequence
  chemically synthesized
QGQSGQGTSYCSIEHYPCNTHHGGGSSGGSISSGLLSGRSDIHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1180 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgacattcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1181 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgacattcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1182 - protein, 151 aa, Artificial Sequence
  chemically synthesized
TSYCSIEHYPCNTHHGGGSSGGSISSGLLSGRSDTHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1183 - protein, 158 aa, Artificial Sequence
  chemically synthesized
QGQSGQGTSYCSIEHYPCNTHHGGGSSGGSISSGLLSGRSDTHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1184 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgacactcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1185 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgacactcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1186 - protein, 151 aa, Artificial Sequence
  chemically synthesized
TSYCSIEHYPCNTHHGGGSSGGSISSGLLSGRSDQHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1187 - protein, 158 aa, Artificial Sequence
  chemically synthesized
QGQSGQGTSYCSIEHYPCNTHHGGGSSGGSISSGLLSGRSDQHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1188 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgaccagcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1189 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgaccagcacggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1190 - protein, 151 aa, Artificial Sequence
  chemically synthesized
TSYCSIEHYPCNTHHGGGSSGGSISSGLLSGRSANPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1191 - protein, 158 aa, Artificial Sequence
  chemically synthesized
QGQSGQGTSYCSIEHYPCNTHHGGGSSGGSISSGLLSGRSANPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1192 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgctaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1193 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgctaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1194 - protein, 151 aa, Artificial Sequence
  chemically synthesized
TSYCSIEHYPCNTHHGGGSSGGSISSGLLSGRSANIGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1195 - protein, 158 aa, Artificial Sequence
  chemically synthesized
QGQSGQGTSYCSIEHYPCNTHHGGGSSGGSISSGLLSGRSANIGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1196 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgctaatattggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1197 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgctaatattggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1198 - protein, 151 aa, Artificial Sequence
  chemically synthesized
TSYCSIEHYPCNTHHGGGSSGGSISSGLLSGRSDNPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1199 - protein, 158 aa, Artificial Sequence
  chemically synthesized
QGQSGQGTSYCSIEHYPCNTHHGGGSSGGSISSGLLSGRSDNPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1200 - DNA, 453 bp, Artificial Sequence
  chemically synthesized
acgtcttactgcagtattgagcattacccctgcaatacacatcatggaggtggctcgagcggcggctctatctcttccggactgctgtccggcagatccgacaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1201 - DNA, 474 bp, Artificial Sequence
  chemically synthesized
caggggcaatctggccaggggacgtcttactgcagtattgagcattacccctgcaatacacatcatggaggtggctcgagcggcggctctatctcttccggactgctgtccggcagatccgacaatcccggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1202 - protein, 152 aa, Artificial Sequence
  chemically synthesized
APRCYMFASYCKSQYGGGSSGGSISSGLLSGRSANPRGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1203 - protein, 159 aa, Artificial Sequence
  chemically synthesized
QGQSGQGAPRCYMFASYCKSQYGGGSSGGSISSGLLSGRSANPRGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIK

SEQ ID NO: 1204 - DNA, 456 bp, Artificial Sequence
  chemically synthesized
gcgcctaggtgctatatgtttgcgtcgtattgcaagagtcagtatggaggtggctcgagcggcggctctatctcttccggactgctgtccggcagatccgccaatcctcgtggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1205 - DNA, 477 bp, Artificial Sequence
  chemically synthesized
caaggccagtctggccaaggtgcgcctaggtgctatatgtttgcgtcgtattgcaagagtcagtatggaggtggctcgagcggcggctctatctcttccggactgctgtccggcagatccgccaatcctcgtggcggaggatccgatatccagctgacccagagccctagcagcctgtctgccagcgtgggcgacagagtgaccatcacctgtagagccagcgagagcgtggacgcttacggcatcagcttcatgaactggttccagcagaagcccggcaaggcccccaagctgctgatctacgccgccagcaatcagggcagcggcgtgccaagcagattttccggctctggcagcggcaccgacttcaccctgaccatcagcagcatgcagcccgaggacttcgccacctactactgccagcagagcaaggacgtgccctggacctttggccagggtaccaagctggaaatcaag

SEQ ID NO: 1206 - protein, 15 aa, Artificial Sequence
  chemically synthesized
RYCHAANPDRFCGIY

SEQ ID NO: 1207 - protein, 15 aa, Artificial Sequence
  chemically synthesized
PRVCSTDGGDYCLLP

SEQ ID NO: 1208 - protein, 15 aa, Artificial Sequence
  chemically synthesized
PRPQCHHRHNCPDHP

SEQ ID NO: 1209 - protein, 15 aa, Artificial Sequence
  chemically synthesized
KCSRPAHQNPDRCSR

SEQ ID NO: 1210 - protein, 15 aa, Artificial Sequence
  chemically synthesized
ASYRCPDYKCSHTKH

SEQ ID NO: 1211 - protein, 15 aa, Artificial Sequence
  chemically synthesized
LPRCPDHPIKCIETK

SEQ ID NO: 1212 - protein, 15 aa, Artificial Sequence
  chemically synthesized
YTFGCPDRYCDRAAT

SEQ ID NO: 1213 - protein, 15 aa, Artificial Sequence
  chemically synthesized
RGCPDFNPPSHCYTA

SEQ ID NO: 1214 - protein, 15 aa, Artificial Sequence
  chemically synthesized
RDYCGPQSPDYCHEI

SEQ ID NO: 1215 - protein, 15 aa, Artificial Sequence
  chemically synthesized
PNKPCPDLQCYVTNY

SEQ ID NO: 1216 - protein, 15 aa, Artificial Sequence
  chemically synthesized
PRVACGEPDLCYSNT

SEQ ID NO: 1217 - protein, 15 aa, Artificial Sequence
  chemically synthesized
RGCKKHTISTLTCPD

SEQ ID NO: 1218 - protein, 15 aa, Artificial Sequence
  chemically synthesized
PAYRCPDRPPCKNQM

SEQ ID NO: 1219 - skipped

SEQ ID NO: 1220 - protein, 15 aa, Artificial Sequence
  chemically synthesized
NARCYPYFGDNCHMN

SEQ ID NO: 1221 - protein, 15 aa, Artificial Sequence
  chemically synthesized
PTLRCPDRWCYDSPR

SEQ ID NO: 1222 - protein, 15 aa, Artificial Sequence
  chemically synthesized
PSNLCPDKWCQTWRS

SEQ ID NO: 1223 - protein, 15 aa, Artificial Sequence
  chemically synthesized
TPRYCAASYCPAHGY

SEQ ID NO: 1224 - protein, 15 aa, Artificial Sequence
  chemically synthesized
RPGCGAVSPRCPDAP

SEQ ID NO: 1225 - protein, 15 aa, Artificial Sequence
  chemically synthesized
VLRCHKQNPDNCNNH

SEQ ID NO: 1226 - protein, 15 aa, Artificial Sequence
  chemically synthesized
GVKSCREPDFCSRGS

SEQ ID NO: 1227 - protein, 15 aa, Artificial Sequence
  chemically synthesized
RNNLCPDYSCNNHNS

SEQ ID NO: 1228 - protein, 15 aa, Artificial Sequence
  chemically synthesized
RAACHRLNPDACTNG

SEQ ID NO: 1229 - protein, 15 aa, Artificial Sequence
  chemically synthesized
VCQSDRIPDYVTCTD

SEQ ID NO: 1230 - protein, 15 aa, Artificial Sequence
  chemically synthesized
RNCRIASINPDYCNI

SEQ ID NO: 1231 - protein, 15 aa, Artificial Sequence
  chemically synthesized
KEWRCPDYKCKPSYH

SEQ ID NO: 1232 - protein, 15 aa, Artificial Sequence
  chemically synthesized
NLRICHKSLCPDYIK

SEQ ID NO: 1233 - protein, 15 aa, Artificial Sequence
  chemically synthesized
NTHKCSNTNICPSFN

SEQ ID NO: 1234 - protein, 15 aa, Artificial Sequence
  chemically synthesized
STRYCQASQCQMSPY

SEQ ID NO: 1235 - protein, 15 aa, Artificial Sequence
  chemically synthesized
THRFCTASLCNKNTS

SEQ ID NO: 1236 - protein, 15 aa, Artificial Sequence
  chemically synthesized
YTLCNTRSPDWCPNK

SEQ ID NO: 1237 - protein, 15 aa, Artificial Sequence
  chemically synthesized
IRCTTGQSPDYCPQS

SEQ ID NO: 1238 - protein, 15 aa, Artificial Sequence
  chemically synthesized
RCNQPDKNDQMLCNI

SEQ ID NO: 1239 - protein, 15 aa, Artificial Sequence
  chemically synthesized
GTCRTDHQSPDYCYY

SEQ ID NO: 1240 - protein, 15 aa, Artificial Sequence
  chemically synthesized
RGCFRSGDSLGMCPD

SEQ ID NO: 1241 - protein, 15 aa, Artificial Sequence
  chemically synthesized
SGCFDSNEHRHCSRI

SEQ ID NO: 1242 - protein, 15 aa, Artificial Sequence
  chemically synthesized
NRCMKLWYNPDCVAR

SEQ ID NO: 1243 - protein, 15 aa, Artificial Sequence
  chemically synthesized
PLCARPHYWSPCDQS

SEQ ID NO: 1244 - protein, 15 aa, Artificial Sequence
  chemically synthesized
DSKCHPNSPDYCFNS

SEQ ID NO: 1245 - protein, 15 aa, Artificial Sequence
  chemically synthesized
NGSCRPLGGDFCGNR

SEQ ID NO: 1246 - protein, 15 aa, Artificial Sequence
  chemically synthesized
KTRCIEMSGDYCAKS

SEQ ID NO: 1247 - protein, 15 aa, Artificial Sequence
  chemically synthesized
IRPCMYNWGDLCNQF

SEQ ID NO: 1248 - protein, 15 aa, Artificial Sequence
  chemically synthesized
VKTCMENNPDYCYNN

SEQ ID NO: 1249 - protein, 15 aa, Artificial Sequence
  chemically synthesized
LRMCFEASGDYCDQQ

SEQ ID NO: 1250 - protein, 15 aa, Artificial Sequence
  chemically synthesized
IRKCQLDGPDQCMLT

SEQ ID NO: 1251 - protein, 15 aa, Artificial Sequence
  chemically synthesized
KWKCHKNNPNYCNNR

SEQ ID NO: 1252 - protein, 15 aa, Artificial Sequence
  chemically synthesized
RTMCLDTNPDYCQSH

SEQ ID NO: 1253 - protein, 15 aa, Artificial Sequence
  chemically synthesized
LAACHSMDSHRCPDY

SEQ ID NO: 1254 - protein, 15 aa, Artificial Sequence
  chemically synthesized
RSPCIHNATMCPDYT

SEQ ID NO: 1255 - protein, 15 aa, Artificial Sequence
  chemically synthesized
MPRCPDWPPRCSMVI

SEQ ID NO: 1256 - protein, 15 aa, Artificial Sequence
  chemically synthesized
VRQLCRLPDYCPSGK

SEQ ID NO: 1257 - protein, 15 aa, Artificial Sequence
  chemically synthesized
PRPPCAQSLNCPDRA

SEQ ID NO: 1258 - protein, 15 aa, Artificial Sequence
  chemically synthesized
SFGRCTLVRTCPDFM

SEQ ID NO: 1259 - protein, 15 aa, Artificial Sequence
  chemically synthesized
RDKPCPDFSCATIHY

SEQ ID NO: 1260 - protein, 15 aa, Artificial Sequence
  chemically synthesized
ATKPCPDRWCTMSTL

SEQ ID NO: 1261 - protein, 15 aa, Artificial Sequence
  chemically synthesized
SSNRCPDLRCTHHNM

SEQ ID NO: 1262 - protein, 15 aa, Artificial Sequence
  chemically synthesized
RGSMCPDLHCSLSHI

SEQ ID NO: 1263 - protein, 15 aa, Artificial Sequence
  chemically synthesized
NYQRCPDRTCMHNII

SEQ ID NO: 1264 - protein, 15 aa, Artificial Sequence
  chemically synthesized
QKRPCPDRKCHAHYN

SEQ ID NO: 1265 - protein, 15 aa, Artificial Sequence
  chemically synthesized
QNHRCPDRWCNKTTN

SEQ ID NO: 1266 - protein, 15 aa, Artificial Sequence
  chemically synthesized
RLNLCPDKHCHMTNL

SEQ ID NO: 1267 - protein, 15 aa, Artificial Sequence
  chemically synthesized
PQDRCPDKRCTNPGN

SEQ ID NO: 1268 - protein, 15 aa, Artificial Sequence
  chemically synthesized
SRWRCPDYKCEHGKY

SEQ ID NO: 1269 - protein, 15 aa, Artificial Sequence
  chemically synthesized
YENQCPDLYCNRYSM

SEQ ID NO: 1270 - protein, 15 aa, Artificial Sequence
  chemically synthesized
TARSCPVFNCPDNNS

SEQ ID NO: 1271 - protein, 15 aa, Artificial Sequence
  chemically synthesized
MDQRCPDAWCTSKPK

SEQ ID NO: 1272 - protein, 15 aa, Artificial Sequence
  chemically synthesized
GDLRCPDRLCPRHSL

SEQ ID NO: 1273 - protein, 15 aa, Artificial Sequence
  chemically synthesized
IQYLCPDYHCKASNN

SEQ ID NO: 1274 - protein, 15 aa, Artificial Sequence
  chemically synthesized
QHHRCPDRYCNSNNN

SEQ ID NO: 1275 - protein, 15 aa, Artificial Sequence
  chemically synthesized
TVALCPDYSCYHINN

SEQ ID NO: 1276 - protein, 15 aa, Artificial Sequence
  chemically synthesized
SPWRCPDRYCLSNHD

SEQ ID NO: 1277 - protein, 15 aa, Artificial Sequence
  chemically synthesized
SSKRCPDRFCNKTHA

SEQ ID NO: 1278 - protein, 15 aa, Artificial Sequence
  chemically synthesized
HTDRCPDYKCSQNHF

SEQ ID NO: 1279 - protein, 15 aa, Artificial Sequence
  chemically synthesized
SRSNCTPQRCNSDYH

SEQ ID NO: 1280 - protein, 15 aa, Artificial Sequence
  chemically synthesized
FAARCPDKYCAIHTN

SEQ ID NO: 1281 - protein, 15 aa, Artificial Sequence
  chemically synthesized
GSARCPDLVCQQTKQ

SEQ ID NO: 1282 - protein, 15 aa, Artificial Sequence
  chemically synthesized
RNLMCPDKFCNKNTK

SEQ ID NO: 1283 - protein, 15 aa, Artificial Sequence
  chemically synthesized
NIRLCPDKVCTPTWV

SEQ ID NO: 1284 - protein, 15 aa, Artificial Sequence
  chemically synthesized
MTDLCPDAHCAKTHM

SEQ ID NO: 1285 - protein, 15 aa, Artificial Sequence
  chemically synthesized
PYSRLCAYPCPDFVG

SEQ ID NO: 1286 - protein, 15 aa, Artificial Sequence
  chemically synthesized
LCGCARSPDYCKCRG

SEQ ID NO: 1287 - protein, 15 aa, Artificial Sequence
  chemically synthesized
WGRCERVPDCCCPRG

SEQ ID NO: 1288 - protein, 15 aa, Artificial Sequence
  chemically synthesized
TRNTCHTRICYGMAC

SEQ ID NO: 1289 - protein, 15 aa, Artificial Sequence
  chemically synthesized
CVCTSCSSYWTLCPD

SEQ ID NO: 1290 - protein, 15 aa, Artificial Sequence
  chemically synthesized
LCCSRGSNCPDRCTW

SEQ ID NO: 1291 - protein, 15 aa, Artificial Sequence
  chemically synthesized
CCPLCQANMCPDNQS

SEQ ID NO: 1292 - protein, 15 aa, Artificial Sequence
  chemically synthesized
ECKLCCPDLYCGGTM

SEQ ID NO: 1293 - protein, 15 aa, Artificial Sequence
  chemically synthesized
CSNPMCAYCCPDLIL

SEQ ID NO: 1294 - protein, 15 aa, Artificial Sequence
  chemically synthesized
CPRCNTYSKHDCYHQ

SEQ ID NO: 1295 - protein, 15 aa, Artificial Sequence
  chemically synthesized
FCCASKMPAPSNCHT

SEQ ID NO: 1296 - protein, 146 aa, Artificial Sequence
  chemically synthesized
RYCHAANPDRFCGIYGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1297 - protein, 153 aa, Artificial Sequence
  chemically synthesized
QGQSGQGRYCHAANPDRFCGIYGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1298 - DNA, 438 bp, Artificial Sequence
  chemically synthesized
cggtattgccatgctgcgaatcctgatcggttttgcggtatttatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1299 - DNA, 459 bp, Artificial Sequence
  chemically synthesized
caaggccagtctggccaaggtcggtattgccatgctgcgaatcctgatcggttttgcggtatttatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1300 - protein, 146 aa, Artificial Sequence
  chemically synthesized
PRVCSTDGGDYCLLPGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1301 - protein, 153 aa, Artificial Sequence
  chemically synthesized
QGQSGQGPRVCSTDGGDYCLLPGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1302 - DNA, 438 bp, Artificial Sequence
  chemically synthesized
cctagggtttgctctactgatggtggtgattattgcttgcttcctggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1303 - DNA, 459 bp, Artificial Sequence
  chemically synthesized
caaggccagtctggccaaggtcctagggtttgctctactgatggtggtgattattgcttgcttcctggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1304 - protein, 146 aa, Artificial Sequence
  chemically synthesized
PRPQCHHRHNCPDHPGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1305 - protein, 153 aa, Artificial Sequence
  chemically synthesized
QGQSGQGPRPQCHHRHNCPDHPGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1306 - DNA, 438 bp, Artificial Sequence
  chemically synthesized
cctcgtccgcagtgccatcatcggcataattgtcctgatcatcctggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1307 - DNA, 459 bp, Artificial Sequence
  chemically synthesized
caaggccagtctggccaaggtcctcgtccgcagtgccatcatcggcataattgtcctgatcatcctggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1308 - protein, 146 aa, Artificial Sequence
  chemically synthesized
KCSRPAHQNPDRCSRGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1309 - protein, 153 aa, Artificial Sequence
  chemically synthesized
QGQSGQGKCSRPAHQNPDRCSRGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1310 - DNA, 438 bp, Artificial Sequence
  chemically synthesized
aagtgctcgcggcctgctcatcagaatccggatcgttgctcgcgaggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1311 - DNA, 459 bp, Artificial Sequence
  chemically synthesized
caaggccagtctggccaaggtaagtgctcgcggcctgctcatcagaatccggatcgttgctcgcgaggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1312 - protein, 146 aa, Artificial Sequence
  chemically synthesized
ASYRCPDYKCSHTKHGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1313 - protein, 153 aa, Artificial Sequence
  chemically synthesized
QGQSGQGASYRCPDYKCSHTKHGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1314 - DNA, 438 bp, Artificial Sequence
  chemically synthesized
gcttcgtatcggtgccctgattataagtgcagtcatactaagcatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1315 - DNA, 459 bp, Artificial Sequence
  chemically synthesized
caaggccagtctggccaaggtgcttcgtatcggtgccctgattataagtgcagtcatactaagcatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1316 - protein, 146 aa, Artificial Sequence
  chemically synthesized
LPRCPDHPIKCIETKGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1317 - protein, 153 aa, Artificial Sequence
  chemically synthesized
QGQSGQGLPRCPDHPIKCIETKGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1318 - DNA, 438 bp, Artificial Sequence
  chemically synthesized
ttgccgaggtgcccggatcatccgattaagtgcattgagactaagggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1319 - DNA, 459 bp, Artificial Sequence
  chemically synthesized
caaggccagtctggccaaggtttgccgaggtgcccggatcatccgattaagtgcattgagactaagggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1320 - protein, 146 aa, Artificial Sequence
  chemically synthesized
YTFGCPDRYCDRAATGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1321 - protein, 153 aa, Artificial Sequence
  chemically synthesized
QGQSGQGYTFGCPDRYCDRAATGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1322 - DNA, 438 bp, Artificial Sequence
  chemically synthesized
tatacgtttggttgccctgataggtattgcgatcgtgcggcgacgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1323 - DNA, 459 bp, Artificial Sequence
  chemically synthesized
caaggccagtctggccaaggttatacgtttggttgccctgataggtattgcgatcgtgcggcgacgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1324 - protein, 146 aa, Artificial Sequence
  chemically synthesized
RGCPDFNPPSHCYTAGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1325 - protein, 153 aa, Artificial Sequence
  chemically synthesized
QGQSGQGRGCPDFNPPSHCYTAGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1326 - DNA, 438 bp, Artificial Sequence
  chemically synthesized
cgtggttgtccggattttaatcctccttctcattgctatactgctggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1327 - DNA, 459 bp, Artificial Sequence
  chemically synthesized
caaggccagtctggccaaggtcgtggttgtccggattttaatcctccttctcattgctatactgctggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1328 - protein, 146 aa, Artificial Sequence
  chemically synthesized
RDYCGPQSPDYCHEIGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1329 - protein, 153 aa, Artificial Sequence
  chemically synthesized
QGQSGQGRDYCGPQSPDYCHEIGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1330 - DNA, 438 bp, Artificial Sequence
  chemically synthesized
agggattattgcgggcctcagagtcctgattattgccatgagattggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1331 - DNA, 459 bp, Artificial Sequence
  chemically synthesized
caaggccagtctggccaaggtagggattattgcgggcctcagagtcctgattattgccatgagattggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1332 - protein, 146 aa, Artificial Sequence
  chemically synthesized
PNKPCPDLQCYVTNYGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1333 - protein, 153 aa, Artificial Sequence
  chemically synthesized
QGQSGQGPNKPCPDLQCYVTNYGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1334 - DNA, 438 bp, Artificial Sequence
  chemically synthesized
ccgaataagccttgcccggatctgcagtgctatgtgacgaattatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1335 - DNA, 459 bp, Artificial Sequence
  chemically synthesized
caaggccagtctggccaaggtccgaataagccttgcccggatctgcagtgctatgtgacgaattatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1336 - protein, 146 aa, Artificial Sequence
  chemically synthesized
PRVACGEPDLCYSNTGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1337 - protein, 153 aa, Artificial Sequence
  chemically synthesized
QGQSGQGPRVACGEPDLCYSNTGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1338 - DNA, 438 bp, Artificial Sequence
  chemically synthesized
ccgcgggttgcttgcggtgagcctgatctttgctattctaatactggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1339 - DNA, 459 bp, Artificial Sequence
  chemically synthesized
caaggccagtctggccaaggtccgcgggttgcttgcggtgagcctgatctttgctattctaatactggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1340 - protein, 146 aa, Artificial Sequence
  chemically synthesized
RGCKKHTISTLTCPDGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1341 - protein, 153 aa, Artificial Sequence
  chemically synthesized
QGQSGQGRGCKKHTISTLTCPDGGGSSGGSISSGLLSGRSDNHGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 1342 - DNA, 438 bp, Artificial Sequence
  chemically synthesized
cgggggtgcaagaagcatactatttcgacgcttacgtgccctgatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1343 - DNA, 459 bp, Artificial Sequence
  chemically synthesized
caaggccagtctggccaaggtcgggggtgcaagaagcatactatttcgacgcttacgtgccctgatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacatttggccagggcaccaaggtggaaatcaag

SEQ ID NO: 1344 - protein, 107 aa, Artificial Sequence [sequence omitted]

SEQ ID NO: 1345 - DNA, 321 bp, Artificial Sequence; identical to SEQ ID NO: 62
  chemically synthesized

SEQ ID NO: 1346 - protein, 113 aa, Artificial Sequence [sequence omitted]

SEQ ID NO: 1347 - DNA, 339 bp, Artificial Sequence
  chemically synthesized
caggtgcagctggtggaatctggcggcggagtggtgcagcctggcagaagcctgagactggactgcaaggccagcggcatcaccttcagcaacagcggcatgcactgggtgcgccaggcccctggaaaaggcctggaatgggtggccgtgatttggtacgacggcagcaagcggtactacgccgacagcgtgaagggccggttcaccatcagccgggacaacagcaagaataccctgttcctgcagatgaacagcctgcgggccgaggacaccgccgtgtactactgcgccaccaacgacgactattggggccagggcacactcgtgaccgtgtcctct

SEQ ID NO: 1348 - protein, 327 aa, Artificial Sequence; identical to SEQ ID NO: 63
  chemically synthesized

SEQ ID NO: 1349 - DNA, 981 bp, Artificial Sequence; identical to SEQ ID NO: 64
  chemically synthesized

SEQ ID NO: 1350 - skipped

SEQ ID NO: 1351 - protein, 15 aa, Artificial Sequence
  chemically synthesized
GCDFTSAKHNCGSGW

SEQ ID NO: 1352 - protein, 15 aa, Artificial Sequence
  chemically synthesized
VGSNCWTGPACALTS

SEQ ID NO: 1353 - protein, 15 aa, Artificial Sequence
  chemically synthesized
FCAVMFDFLSDRCLH

SEQ ID NO: 1354 - protein, 15 aa, Artificial Sequence
  chemically synthesized
FCPPWLDYLGNKCMT

SEQ ID NO: 1355 - protein, 15 aa, Artificial Sequence
  chemically synthesized
MSCWDFSSAQGCGQH

SEQ ID NO: 1356 - protein, 15 aa, Artificial Sequence
  chemically synthesized
LMCADLHYNHYNCKY

SEQ ID NO: 1357 - protein, 15 aa, Artificial Sequence
  chemically synthesized
ELCGWQSFSGVCTSE

SEQ ID NO: 1358 - protein, 15 aa, Artificial Sequence
  chemically synthesized
WTYENCWASCQPHLE

SEQ ID NO: 1359 - protein, 10 aa, Artificial Sequence
  chemically synthesized
KLTEDFSSAA

SEQ ID NO: 1360 - protein, 15 aa, Artificial Sequence
  chemically synthesized
VGQSCFSGLVCDRQL

SEQ ID NO: 1361 - protein, 13 aa, Artificial Sequence
  chemically synthesized
ISHYCFSGKSCRD

SEQ ID NO: 1362 - protein, 15 aa, Artificial Sequence
  chemically synthesized
HCIPDFTSAAGDCMR

SEQ ID NO: 1363 - protein, 9 aa, Artificial Sequence
  chemically synthesized
RLVSAYSFS

SEQ ID NO: 1364 - protein, 15 aa, Artificial Sequence
  chemically synthesized
KFHHSHPLVHDFTSA

SEQ ID NO: 1365 - protein, 15 aa, Artificial Sequence
  chemically synthesized
ASYPDFSSANGVGLR

SEQ ID NO: 1366 - protein, 15 aa, Artificial Sequence
  chemically synthesized
GLATTLSNVDFTSAG

SEQ ID NO: 1367 - protein, 15 aa, Artificial Sequence
  chemically synthesized
DFTSANSAFSGDAST

SEQ ID NO: 1368 - protein, 15 aa, Artificial Sequence
  chemically synthesized
GRLPGHSVVDFTSAW

SEQ ID NO: 1369 - protein, 15 aa, Artificial Sequence
  chemically synthesized
SGSFYSSSAFDFTSA

SEQ ID NO: 1370 - protein, 15 aa, Artificial Sequence
  chemically synthesized
CDDFTSAQHSRINEC

SEQ ID NO: 1371 - protein, 15 aa, Artificial Sequence
  chemically synthesized
CDFTSAQGKKCRTAL

SEQ ID NO: 1372 - protein, 15 aa, Artificial Sequence
  chemically synthesized
YYIDKYQSPSYGPVL

SEQ ID NO: 1373 - protein, 15 aa, Artificial Sequence
  chemically synthesized
FSVARARSSADFTSS

SEQ ID NO: 1374 - protein, 15 aa, Artificial Sequence
  chemically synthesized
DSDFTSAGSADSRSR

SEQ ID NO: 1375 - protein, 15 aa, Artificial Sequence
  chemically synthesized
CDFTSATSISKRCDH

SEQ ID NO: 1376 - protein, 15 aa, Artificial Sequence
  chemically synthesized
IESSASSWGLQASRN

SEQ ID NO: 1377 - protein, 17 aa, Artificial Sequence
  chemically synthesized
PRYHNLNFTTPALSPGS

SEQ ID NO: 1378 - protein, 15 aa, Artificial Sequence
  chemically synthesized
DLFARFPLDRDFTSA

SEQ ID NO: 1379 - protein, 15 aa, Artificial Sequence
  chemically synthesized
HCNFTTPPYCSSTLW

SEQ ID NO: 1380 - protein, 15 aa, Artificial Sequence
  chemically synthesized
NVPIILLTDRQLLSG

SEQ ID NO: 1381 - protein, 15 aa, Artificial Sequence
  chemically synthesized
NPTACDFTSSMATYC

SEQ ID NO: 1382 - protein, 15 aa, Artificial Sequence
  chemically synthesized
FVRTVRFSNSMFSVP

SEQ ID NO: 1383 - protein, 15 aa, Artificial Sequence
  chemically synthesized
YDFSSASNSSPSRQT

SEQ ID NO: 1384 - protein, 15 aa, Artificial Sequence
  chemically synthesized
AHPDFSSAMRGNLLG

SEQ ID NO: 1385 - protein, 15 aa, Artificial Sequence
  chemically synthesized
SSHVVHKDFTSANSR

SEQ ID NO: 1386 - protein, 15 aa, Artificial Sequence
  chemically synthesized
CPDFTSANGGGCWQM

SEQ ID NO: 1387 - protein, 15 aa, Artificial Sequence
  chemically synthesized
SLGQSYPTDFTCPGC

SEQ ID NO: 1388 - protein, 15 aa, Artificial Sequence
  chemically synthesized
ASMRSHEQRDFTSAY

SEQ ID NO: 1389 - protein, 15 aa, Artificial Sequence
  chemically synthesized
SCQFWFTLCSGGVFH

SEQ ID NO: 1390 - protein, 15 aa, Artificial Sequence
  chemically synthesized
PYPNNRTGMHDFTSA

SEQ ID NO: 1391 - protein, 15 aa, Artificial Sequence
  chemically synthesized
KPFPIDFTSAGTSGT

SEQ ID NO: 1392 - protein, 15 aa, Artificial Sequence
  chemically synthesized
SIKSFIPRDDFTSAA

SEQ ID NO: 1393 - protein, 15 aa, Artificial Sequence
  chemically synthesized
GIKNPATPFVDFTSA

SEQ ID NO: 1394 - protein, 15 aa, Artificial Sequence
  chemically synthesized
LSHTYPRGSSTIEAS

SEQ ID NO: 1395 - protein, 9 aa, Artificial Sequence
  chemically synthesized
PSLDFSSAT

SEQ ID NO: 1396 - protein, 15 aa, Artificial Sequence
  chemically synthesized
AFTPRIAPTFDVMKE

SEQ ID NO: 1397 - protein, 13 aa, Artificial Sequence
  chemically synthesized
LCGLQIPPDCERS

SEQ ID NO: 1398 - protein, 15 aa, Artificial Sequence
  chemically synthesized
AAKMVSHSERDFTSA

SEQ ID NO: 1399 - protein, 15 aa, Artificial Sequence
  chemically synthesized
VSVECFSGMQCPHYY

SEQ ID NO: 1400 - protein, 15 aa, Artificial Sequence
  chemically synthesized
ASKCRLPCMASTQIY

SEQ ID NO: 1401 - protein, 15 aa, Artificial Sequence
  chemically synthesized
GLRSCNIYFSIPCTY

SEQ ID NO: 1402 - protein, 15 aa, Artificial Sequence
  chemically synthesized
RGTSDGTLDFTTARS

SEQ ID NO: 1403 - protein, 15 aa, Artificial Sequence
  chemically synthesized
SMYPSASRLLHPQYP

SEQ ID NO: 1404 - protein, 15 aa, Artificial Sequence
  chemically synthesized
HCISCYDFTSAAGSF

SEQ ID NO: 1405 - protein, 15 aa, Artificial Sequence
  chemically synthesized
SSGRWGDAWACARIC

SEQ ID NO: 1406 - protein, 15 aa, Artificial Sequence
  chemically synthesized
RVFSDFTSASHSFGG

SEQ ID NO: 1407 - protein, 15 aa, Artificial Sequence
  chemically synthesized
TDRHSASGRDFTSAH

SEQ ID NO: 1408 - protein, 17 aa, Artificial Sequence
  chemically synthesized
AHCEDFSSAERIATMGC

SEQ ID NO: 1409 - protein, 15 aa, Artificial Sequence
  chemically synthesized
ACDPYSFSIPCDDRL

SEQ ID NO: 1410 - protein, 12 aa, Artificial Sequence
  chemically synthesized
NSPFTLSHIYDR

SEQ ID NO: 1411 - protein, 15 aa, Artificial Sequence
  chemically synthesized
IGTNFTTPSAFVAFP

SEQ ID NO: 1412 - protein, 15 aa, Artificial Sequence
  chemically synthesized
RDAFPIYRNADFSTP

SEQ ID NO: 1413 - protein, 15 aa, Artificial Sequence
  chemically synthesized
SIPNASSYNFTSSSG

SEQ ID NO: 1414 - protein, 15 aa, Artificial Sequence
  chemically synthesized
AGIPDKRHTYDFTSA

SEQ ID NO: 1415 - protein, 15 aa, Artificial Sequence
  chemically synthesized
WPLAHDSRDWNFTTP

SEQ ID NO: 1416 - protein, 15 aa, Artificial Sequence
  chemically synthesized
RHSPSSGHVDFTSAG

SEQ ID NO: 1417 - protein, 15 aa, Artificial Sequence
  chemically synthesized
SCFAWTDPVWNRCSW

SEQ ID NO: 1418 - protein, 15 aa, Artificial Sequence
  chemically synthesized
MPCDWTGPGKIWCGG

SEQ ID NO: 1419 - protein, 15 aa, Artificial Sequence
  chemically synthesized
RDCDFSTANFRSCNK

SEQ ID NO: 1420 - protein, 15 aa, Artificial Sequence
  chemically synthesized
LSCVVSPNYLHCNDH

SEQ ID NO: 1421 - protein, 15 aa, Artificial Sequence
  chemically synthesized
FVCGLYSFSGVCQGV

SEQ ID NO: 1422 - protein, 15 aa, Artificial Sequence
  chemically synthesized
IGLMCFSGLQCPMLA

SEQ ID NO: 1423 - protein, 15 aa, Artificial Sequence
  chemically synthesized
PGMNCFSGEICQMST

SEQ ID NO: 1424 - protein, 15 aa, Artificial Sequence
  chemically synthesized
GDVGSCWASCGLQGG

SEQ ID NO: 1425 - protein, 15 aa, Artificial Sequence
  chemically synthesized
SQFQDCWASCGASFT

SEQ ID NO: 1426 - protein, 15 aa, Artificial Sequence
  chemically synthesized
VGSLNCWYSCGDIWL

SEQ ID NO: 1427 - protein, 15 aa, Artificial Sequence
  chemically synthesized
MCESWLNFLGDQCGM

SEQ ID NO: 1428 - protein, 15 aa, Artificial Sequence
  chemically synthesized
RCMISQSSFSGMCGM

SEQ ID NO: 1429 - protein, 15 aa, Artificial Sequence
  chemically synthesized
NCAPWTSNMSNHCLK

SEQ ID NO: 1430 - protein, 15 aa, Artificial Sequence
  chemically synthesized
LCGVGSATGLELCGV

SEQ ID NO: 1431 - protein, 15 aa, Artificial Sequence
  chemically synthesized
GCDFSSLGGRQPCTP

SEQ ID NO: 1432 - protein, 15 aa, Artificial Sequence
  chemically synthesized
MGCNFTTYPYHTCNT

SEQ ID NO: 1433 - protein, 15 aa, Artificial Sequence
  chemically synthesized
GSCDFTSGAGKKCGS

SEQ ID NO: 1434 - protein, 15 aa, Artificial Sequence
  chemically synthesized
VSCDFTSSHARMCSR

SEQ ID NO: 1435 - protein, 15 aa, Artificial Sequence
  chemically synthesized
MRCTDFYYNHTNCIG

SEQ ID NO: 1436 - protein, 15 aa, Artificial Sequence
  chemically synthesized
RSCDFTSAANKYCAT

SEQ ID NO: 1437 - protein, 15 aa, Artificial Sequence
  chemically synthesized
LYCDSFSVPRPNCAP

SEQ ID NO: 1438 - protein, 15 aa, Artificial Sequence
  chemically synthesized
NSCDFTSARVSKCST

SEQ ID NO: 1439 - protein, 15 aa, Artificial Sequence
  chemically synthesized
STCSDNFTTPMPCNT

SEQ ID NO: 1440 - protein, 15 aa, Artificial Sequence
  chemically synthesized
DICNDRPNLTHCHYF

SEQ ID NO: 1441 - protein, 15 aa, Artificial Sequence
  chemically synthesized
LRCDDFTSAIGCRGY

SEQ ID NO: 1442 - protein, 15 aa, Artificial Sequence
  chemically synthesized
EGCDFTSALHSCNNY

SEQ ID NO: 1443 - protein, 15 aa, Artificial Sequence
  chemically synthesized
RKGCGDFTSASCFVV

SEQ ID NO: 1444 - protein, 15 aa, Artificial Sequence
  chemically synthesized
GMLCAGSSFGLCESM

SEQ ID NO: 1445 - protein, 15 aa, Artificial Sequence
  chemically synthesized
RESCFGSSLGLCTNK

SEQ ID NO: 1446 - protein, 15 aa, Artificial Sequence
  chemically synthesized
ILRCYDIPTNCMNFN

SEQ ID NO: 1447 - protein, 15 aa, Artificial Sequence
  chemically synthesized
NSECTFGAMYCRNKP

SEQ ID NO: 1448 - protein, 15 aa, Artificial Sequence
  chemically synthesized
ASGCFDEDIRCSGGA

SEQ ID NO: 1449 - protein, 15 aa, Artificial Sequence
  chemically synthesized
HYFCNQSNPSCQTAP

SEQ ID NO: 1450 - protein, 15 aa, Artificial Sequence
  chemically synthesized
AMGCELGGAGCIGSP

SEQ ID NO: 1451 - protein, 15 aa, Artificial Sequence
  chemically synthesized
TLKCHMPRKLCANDP

SEQ ID NO: 1452 - protein, 15 aa, Artificial Sequence
  chemically synthesized
RPACRDLPHNCITST

SEQ ID NO: 1453 - protein, 15 aa, Artificial Sequence
  chemically synthesized
QMSCHGNFTTCHSNP

SEQ ID NO: 1454 - protein, 15 aa, Artificial Sequence
  chemically synthesized
LTGCARGARPCRLRV

SEQ ID NO: 1455 - protein, 15 aa, Artificial Sequence
  chemically synthesized
WSELCLAGPSCGWVG

SEQ ID NO: 1456 - protein, 15 aa, Artificial Sequence
  chemically synthesized
VTKSCWQLPHCITAP

SEQ ID NO: 1457 - protein, 15 aa, Artificial Sequence
  chemically synthesized
KAASCPHNQICNMTA

SEQ ID NO: 1458 - protein, 15 aa, Artificial Sequence
  chemically synthesized
VSKNCFSGMMCPVFA

SEQ ID NO: 1459 - protein, 15 aa, Artificial Sequence
  chemically synthesized
NRSSCWTGPTCHVLH

SEQ ID NO: 1460 - protein, 15 aa, Artificial Sequence
  chemically synthesized
ARTGCSGPVCLNDVS

SEQ ID NO: 1461 - protein, 15 aa, Artificial Sequence
  chemically synthesized
STRTCLAFTCINGNT

SEQ ID NO: 1462 - protein, 15 aa, Artificial Sequence
  chemically synthesized
MLDGNCWYACSYKNT

SEQ ID NO: 1463 - protein, 15 aa, Artificial Sequence
  chemically synthesized
FSRSDCWSACAPWRV

SEQ ID NO: 1464 - protein, 15 aa, Artificial Sequence
  chemically synthesized
GGRMDCWASCQPLSR

SEQ ID NO: 1465 - protein, 15 aa, Artificial Sequence
  chemically synthesized
NSPHSCMTNCDFTSA

SEQ ID NO: 1466 - protein, 147 aa, Artificial Sequence
  chemically synthesized
CDFTSAKHNCGSGWGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1467 - protein, 154 aa, Artificial Sequence
  chemically synthesized
QGQSGQGCDFTSAKHNCGSGWGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1468 - DNA, 441 bp, Artificial Sequence
  chemically synthesized
tgcgattttacttctgccaagcacaattgcggctctggctggggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1469 - DNA, 462 bp, Artificial Sequence
  chemically synthesized
caaggccagtctggccaaggatgcgattttacttctgccaagcacaattgcggctctggctggggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1470 - protein, 150 aa, Artificial Sequence
  chemically synthesized
VGSNCWTGPACALTSGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1471 - protein, 157 aa, Artificial Sequence
  chemically synthesized
QGQSGQGVGSNCWTGPACALTSGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1472 - DNA, 450 bp, Artificial Sequence
  chemically synthesized
gttgggtcgaattgctggacggggccggcgtgcgctttgacgtcgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1473 - DNA, 471 bp, Artificial Sequence
  chemically synthesized
caaggccagtctggccaaggtgttgggtcgaattgctggacggggccggcgtgcgctttgacgtcgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1474 - protein, 150 aa, Artificial Sequence
  chemically synthesized
FCAVMFDFLSDRCLHGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1475 - protein, 157 aa, Artificial Sequence
  chemically synthesized
QGQSGQGFCAVMFDFLSDRCLHGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1476 - DNA, 450 bp, Artificial Sequence
  chemically synthesized
ttttgcgctgtgatgtttgattttctgtctgatcggtgcctgcatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1477 - DNA, 471 bp, Artificial Sequence
  chemically synthesized
caaggccagtctggccaaggtttttgcgctgtgatgtttgattttctgtctgatcggtgcctgcatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1478 - protein, 150 aa, Artificial Sequence
  chemically synthesized
FCPPWLDYLGNKCMTGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1479 - protein, 157 aa, Artificial Sequence
  chemically synthesized
QGQSGQGFCPPWLDYLGNKCMTGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1480 - DNA, 450 bp, Artificial Sequence
  chemically synthesized
ttttgcccgccgtggttggattatttgggtaataagtgcatgacgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1481 - DNA, 471 bp, Artificial Sequence
  chemically synthesized
caaggccagtctggccaaggtttttgcccgccgtggttggattatttgggtaataagtgcatgacgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1482 - protein, 150 aa, Artificial Sequence
  chemically synthesized
MSCWDFSSAQGCGQHGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1483 - protein, 157 aa, Artificial Sequence
  chemically synthesized
QGQSGQGMSCWDFSSAQGCGQHGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1484 - DNA, 450 bp, Artificial Sequence
  chemically synthesized
atgtcttgctgggatttttcttcggctcaggggtgcggtcagcatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1485 - DNA, 471 bp, Artificial Sequence
  chemically synthesized
caaggccagtctggccaaggtatgtcttgctgggatttttcttcggctcaggggtgcggtcagcatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1486 - protein, 150 aa, Artificial Sequence
  chemically synthesized
LMCADLHYNHYNCKYGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1487 - protein, 157 aa, Artificial Sequence
  chemically synthesized
QGQSGQGLMCADLHYNHYNCKYGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1488 - DNA, 450 bp, Artificial Sequence
  chemically synthesized
ttgatgtgcgctgatttgcattataatcattataattgcaagtatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1489 - DNA, 471 bp, Artificial Sequence
  chemically synthesized
caaggccagtctggccaaggtttgatgtgcgctgatttgcattataatcattataattgcaagtatggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1490 - protein, 150 aa, Artificial Sequence
  chemically synthesized
ELCGWQSFSGVCTSEGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1491 - protein, 157 aa, Artificial Sequence
  chemically synthesized
QGQSGQGELCGWQSFSGVCTSEGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1492 - DNA, 450 bp, Artificial Sequence
  chemically synthesized
gagttgtgcggttggcagagtttttcgggggtttgcactagtgagggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1493 - DNA, 471 bp, Artificial Sequence
  chemically synthesized
caaggccagtctggccaaggtgagttgtgcggttggcagagtttttcgggggtttgcactagtgagggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1494 - protein, 150 aa, Artificial Sequence
  chemically synthesized
WTYENCWASCQPHLEGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1495 - protein, 157 aa, Artificial Sequence
  chemically synthesized
QGQSGQGWTYENCWASCQPHLEGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1496 - DNA, 450 bp, Artificial Sequence
  chemically synthesized
tggacttatgagaattgctgggcttcgtgccagcctcatttggagggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1497 - DNA, 471 bp, Artificial Sequence
  chemically synthesized
caaggccagtctggccaaggttggacttatgagaattgctgggcttcgtgccagcctcatttggagggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1498 - protein, 143 aa, Artificial Sequence
  chemically synthesized
KLTEDFSSAAGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1499 - protein, 149 aa, Artificial Sequence
  chemically synthesized
QGQSGQKLTEDFSSAAGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1500 - DNA, 429 bp, Artificial Sequence
  chemically synthesized
aagcttactgaggatttttctagcgcagcaggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1501 - DNA, 447 bp, Artificial Sequence
  chemically synthesized
caaggccagtctggccaaaagcttactgaggatttttctagcgcagcaggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1502 - protein, 150 aa, Artificial Sequence
  chemically synthesized
VGQSCFSGLVCDRQLGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1503 - protein, 157 aa, Artificial Sequence
  chemically synthesized
QGQSGQGVGQSCFSGLVCDRQLGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1504 - DNA, 450 bp, Artificial Sequence
  chemically synthesized
gtggggcagagttgcttttctgggctggtttgcgataggcagctgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1505 - DNA, 471 bp, Artificial Sequence
  chemically synthesized
caaggccagtctggccaaggtgtggggcagagttgcttttctgggctggtttgcgataggcagctgggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1506 - protein, 146 aa, Artificial Sequence
  chemically synthesized
ISHYCFSGKSCRDGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1507 - protein, 152 aa, Artificial Sequence
  chemically synthesized
QGQSGQISHYCFSGKSCRDGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1508 - DNA, 438 bp, Artificial Sequence
  chemically synthesized
atctctcactattgtttcagtggcaaatcctgcagggacggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1509 - DNA, 456 bp, Artificial Sequence
  chemically synthesized
caaggccagtctggccaaatctctcactattgtttcagtggcaaatcctgcagggacggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1510 - protein, 150 aa, Artificial Sequence
  chemically synthesized
HCIPDFTSAAGDCMRGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1511 - protein, 157 aa, Artificial Sequence
  chemically synthesized
QGQSGQGHCIPDFTSAAGDCMRGGGSSGGSISSGLLSGRSDNHGGSEIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIK

SEQ ID NO: 1512 - DNA, 450 bp, Artificial Sequence
  chemically synthesized
cattgcattcctgattttacttctgctgctggtgattgcatgaggggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1513 - DNA, 471 bp, Artificial Sequence
  chemically synthesized
caaggccagtctggccaaggtcattgcattcctgattttacttctgctgctggtgattgcatgaggggaggtggctcgagcggcggctctatctcttccggactgctgtccggcagatccgacaatcacggcggatccgagatcgtgctgacacagagccctgccaccctgtctctgagccctggcgaaagagccaccctgagctgtagagcctctaagggcgtgtccaccagcggctacagctacctgcactggtatcagcagaagcccggccaggcccccagactgctgatctacctggcctcctacctggaaagcggcgtgcccgccagattttctggctctggcagcggcaccgacttcaccctgacaatcagcagcctggaacccgaggacttcgccgtgtactactgccagcacagcagggacctgcccctgacatttggcggaggcaccaaggtggaaatcaag

SEQ ID NO: 1514 - protein, 120 aa, Artificial Sequence [sequence omitted]

SEQ ID NO: 1515 - DNA, 360 bp, Artificial Sequence
  chemically synthesized
caggtgcagctggtgcagtctggcgtggaagtgaagaaaccaggcgccagcgtgaaggtgtcctgcaaggccagcggctacacctttaccaactactacatgtactgggtgcgccaggccccaggccagggactggaatggatgggcggcatcaaccccagcaacggcggcaccaacttcaacgagaagttcaagaacagagtgaccctgaccaccgacagcagcaccaccaccgcctacatggaactgaagtccctgcagttcgacgacaccgccgtgtactactgcgccagacgggactacagattcgacatgggcttcgactactggggccagggcacaaccgtgaccgtgtctagt

SEQ ID NO: 1516 - protein, 330 aa, Artificial Sequence
  chemically synthesized
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLEGGPSVFIFPPKIKDVLMISLSPIVTCVVVDVSEDDPDVQISWFVNNVEVHTAQTQTHREDYNSTLRVVSALPIQHQDWMSGKAFACAVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1517 - DNA, 990 bp, Artificial Sequence
  chemically synthesized
gccaagacaacagcccccagcgtgtaccctctggcccctgtgtgtggcgataccacaggcagctctgtgaccctgggctgcctcgtgaagggctacttccctgagccagtgaccctgacctggaacagcggctctctgtctagcggcgtgcacacctttccagccgtgctgcagagcgacctgtacaccctgagcagcagcgtgaccgtgaccagcagcacatggcccagccagagcatcacctgtaacgtggcccaccctgccagctccaccaaggtggacaagaagatcgagcccagaggccccaccatcaagccttgccccccttgcaaatgccctgcccccaatctggaaggcggccctagcgtgttcatcttcccacccaagatcaaggacgtgctgatgatcagcctgagccccatcgtgacctgcgtggtggtggacgtgtccgaggacgaccccgatgtgcagatcagttggttcgtgaacaacgtggaagtgcacaccgcccagacccagacacacagagaggactacaacagcaccctgagagtggtgtccgccctgcccatccagcaccaggattggatgagcggcaaggccttcgcctgcgctgtgaacaacaaggacctgccagcccccatcgagcggaccatctctaagcctaagggcagcgtgcgggctccccaggtgtacgtgctgcctcctccagaggaagagatgaccaagaaacaagtgacactgacatgcatggtcaccgacttcatgcccgaggacatctacgtggaatggaccaacaacggcaagaccgagctgaactacaagaacaccgagcccgtgctggacagcgacggcagctacttcatgtacagcaagctgcgggtggaaaagaaaaactgggtggaacggaacagctacagctgcagcgtggtgcacgagggcctgcacaatcaccacaccaccaagagcttcagccggacccctggaaaa

SEQ ID NO: 1518 - DNA, 18 bp, Artificial Sequence
  chemically synthesized
caaggccagtctggccaa

SEQ ID NO: 1519 - protein, 6 aa, Artificial Sequence
  chemically synthesized
GGSGGS

SEQ ID NO: 1520 - protein, 8 aa, Artificial Sequence
  chemically synthesized
LSGRSDNP

SEQ ID NO: 1521 - protein, 121 aa, Artificial Sequence
  chemically synthesized
EVQLVESGGGLVQPGGSLRLSCAASGFTFSDYGMHWVRQAPGKGLEWVAYISSGSYTIYSADSVKGRFTISRDNAKNTLYLQMSSLRAEDTAVYYCARRGYGSFYEYYFDYWGQGTTVTVS

SEQ ID NO: 1522 - protein, 106 aa, Artificial Sequence
  chemically synthesized
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 1523 - protein, 117 aa, Artificial Sequence
  chemically synthesized
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 1524 - protein, 117 aa, Artificial Sequence
  chemically synthesized
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSS

SEQ ID NO: 1525 - protein, 117 aa, Artificial Sequence
  chemically synthesized
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSS

SEQ ID NO: 1526 - protein, 113 aa, Artificial Sequence
  chemically synthesized
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIK

SEQ ID NO: 1527 - protein, 113 aa, Artificial Sequence
  chemically synthesized
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIK

SEQ ID NO: 1528 - protein, 113 aa, Artificial Sequence
  chemically synthesized
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 1529 - protein, 113 aa, Artificial Sequence
  chemically synthesized
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 1530 - protein, 113 aa, Artificial Sequence
  chemically synthesized
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 1531 - protein, 113 aa, Artificial Sequence
  chemically synthesized
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 1532 - protein, 113 aa, Artificial Sequence
  chemically synthesized
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 1533 - protein, 113 aa, Artificial Sequence
  chemically synthesized
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIK

SEQ ID NO: 1534 - protein, 113 aa, Artificial Sequence
  chemically synthesized
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIK

SEQ ID NO: 1535 - protein, 444 aa, Artificial Sequence
  chemically synthesized
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1536 - protein, 444 aa, Artificial Sequence
  chemically synthesized
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1537 - protein, 444 aa, Artificial Sequence
  chemically synthesized
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1538 - protein, 444 aa, Artificial Sequence
  chemically synthesized
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1539 - protein, 443 aa, Artificial Sequence
  chemically synthesized
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1540 - protein, 443 aa, Artificial Sequence
  chemically synthesized
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1541 - protein, 220 aa, Artificial Sequence
  chemically synthesized
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1542 - protein, 220 aa, Artificial Sequence
  chemically synthesized
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1543 - protein, 220 aa, Artificial Sequence
  chemically synthesized
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1544 - protein, 220 aa, Artificial Sequence
  chemically synthesized
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1545 - protein, 220 aa, Artificial Sequence
  chemically synthesized
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1546 - protein, 220 aa, Artificial Sequence
  chemically synthesized
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1547 - protein, 220 aa, Artificial Sequence
  chemically synthesized
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1548 - protein, 220 aa, Artificial Sequence
  chemically synthesized
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1549 - protein, 121 aa, Artificial Sequence
  chemically synthesized
EVQLLESGGGLVQPGGSLRLSCSASGFTFSSYTMNWVRQAPGKGLEWVSGISDTGGNTYYTDSVKGRFTVSRDNSKNTLSLQMNSLRAEDTAVYYCAKDQGGSYPYYFHYWGQGSLVTVSS

SEQ ID NO: 1550 - protein, 122 aa, Artificial Sequence
  chemically synthesized
EVQLVESGGGLVQPGGSLRLSCAASGFTVSNNYMSWVRQAPGKGLEWVSVIYSGGFTYYTDSVKGRFTISRHNSKNTLYLQMNSLRAEDTAVYYCARYYYDTSDYWTFFDYWGQGTLVTVSS

SEQ ID NO: 1551 - protein, 119 aa, Artificial Sequence
  chemically synthesized
QVQLVESGGGVVQSGRSLRLSCAASGFTFSSYGMHWVRQAPGKGLEWVAVIWYDGSNIYYSDSVKGRFTISRANSKNTLYLQMNSLRAEDTAVYYCARPGHWNYFFEYWGQGTLVTVSS

SEQ ID NO: 1552 - protein, 122 aa, Artificial Sequence
  chemically synthesized
EVQLVESGGGLVQPGGSLRLSCGASGFTFRNYDMHWVRQITGKGLEWVSAIGSAGDTYYPDSVKGRFTISRENAKNSLYLQMNSLRVGDTAVYYCTRDIHCSSTRCYGMDVWGQGTTVTVSS

SEQ ID NO: 1553 - protein, 130 aa, Artificial Sequence
  chemically synthesized
EVQLVESGGGLVKPGGSLRLSCAASGFKFSNEWMSWVRQAPGKGLEWVGRIKSKTDGGTTDYAAPVKGRFTISRDDSKNTLYLQMNSLKTEDTAVYYCTTDQDFWSGYYTGADYYGMDVWGQGTMVTVSS

SEQ ID NO: 1554 - protein, 116 aa, Artificial Sequence
  chemically synthesized
QMQLQQWGAGLLKPSETLSLTCVVYGGSLNGYYWSWIRQSPGKGLEWIGEIDHSGSTNYNPSLKNRVTMSVDTSKIQFSLKLTSVTVADTAVYYCAREGLLPFDYWGQGTLVTVSS

SEQ ID NO: 1555 - protein, 123 aa, Artificial Sequence
  chemically synthesized
QLQLQESGPDLVKPSDTLSLTCTVSDDSISSTTYYWAWIRQPPGKGLEWIGSMSYNGNNYYNPSLKSRVAISAGTSQKQFSLKLTSVTAADTAVYHCARHLGYNGNWYPFDFWGQGILVTVSS

SEQ ID NO: 1556 - protein, 122 aa, Artificial Sequence
  chemically synthesized
EVQVVESGGGLVEPGRSLRLSCKASGFTFDDYAMHWVRQTPGKALEWVSGINWSGNNIGYADSVKGRFTISKDDAKNSLYLQMNSLRPEDTALYYCTKDISITGTLDAFDVWGQGTMVTVSS

SEQ ID NO: 1557 - protein, 115 aa, Artificial Sequence
  chemically synthesized
QVQLVESGGGVVQPGRSLRLSCAASGFTFSSYGMHWVRQAPGKGLEWVAIIWSDGDSEYNLDSVKGRFTISRDNSKNTLYLQMNSLRVEDSAVYYCARDRDLEDIWGQGTMVTSS

SEQ ID NO: 1558 - protein, 117 aa, Artificial Sequence [sequence omitted]

SEQ ID NO: 1559 - protein, 121 aa, Artificial Sequence
  chemically synthesized
EVQLVESGGGVVRPGGSLRLSCAASGFTFDDYGMSWVRQVPGKGLEWVSGISWNDGKTVYAESVKGRFIISRDNAKNSLYLEMNSLRAEDTALYYCARDWQYLIERYFDYWGQGTLVTVSS

SEQ ID NO: 1560 - protein, 121 aa, Artificial Sequence
  chemically synthesized
EVQLVESGGGVVRPGGSLRLSCTASGFTFDDYGMSWVRQAPGKGLEWISGIGWTGGRSSYADSVRGRFTISRDNAKNSLYLQMNSLGAEDTALYYCARDRQWLVQWYFDYWGQGTLVTVSS

SEQ ID NO: 1561 - protein, 121 aa, Artificial Sequence
  chemically synthesized
EVQLVESGGRVVRPGGSLRLSCAASGFTFDDYGMSWVRQLPGKGLEWVAGISWNDGKTVYAESVKGRFIISRDNAKNSLHLEMNSLRAEDTALYYCARDWQYLIDRYFDFWGQGTLVTVSS

SEQ ID NO: 1562 - protein, 121 aa, Artificial Sequence
  chemically synthesized
EVQLVESGGGLVQPGGSLRLSCAASGFTFDDYAMHWVRQAPGKGLEWVSGIGWSSGSIGYADSVKGRFTISRDNAKNSLYLQMDSLRPEDSALYYCAKAYTFMITLYFDYWGQGTLVTVSS

SEQ ID NO: 1563 - protein, 121 aa, Artificial Sequence
  chemically synthesized
EVQLVESGGGLVQPGRSLRLSCAASGFTFDDYDMHWVRQAPGKGLEWVSGSGWNRGSLGYADSVKGRFTISRDNAKKSLYLQMNSVRVEDTALYYCAKGFVVVSAAYFDYWGQGTLVTVSS

SEQ ID NO: 1564 - protein, 121 aa, Artificial Sequence
  chemically synthesized
QVQLVQSGAEVKRPGSSVKVSCKVSGVTFRNFAIIWVRQAPGQGLEWMGGIIPFFSAANYAQSFQGRVTITPDESTSTAFMELASLRSEDTAVYYCAREGERGHTYGFDYWGQGTLVTVSS

SEQ ID NO: 1565 - protein, 121 aa, Artificial Sequence
  chemically synthesized
EVQLVESGGGLVQSGRSLRLSCAASGFTFDDYAMHWVRQPPGKGLEWVSGINWNRGRTGYADSVKGRFTISRDNAKNSLYLQMNDLRVEDTALYYCAKAEQWLDEGYFDYWGQGTLVTVSS

SEQ ID NO: 1566 - protein, 121 aa, Artificial Sequence
  chemically synthesized
EVQLVESGGGLVQRGGSLRLSCAASGFSFSSYAMNWVRQAPGKGLEWVSTISDSGGSTYYADSVKGRFTISRDNSKNTLSLQMNSLRAEDTAVYYCAKDQGGSYPYYFHYWGQGTLVTVSS

SEQ ID NO: 1567 - protein, 121 aa, Artificial Sequence
  chemically synthesized
EVQLVESGGGLVQPGRSLRLSCAASGFTFEDYAMHWVRQAPGKGLEWVSGIGWSNVKIGYADSVKGRFTISRDNVRNSLYLQMNSLRTEDTAFYYCVKAYTSMLTLYFDYWGQGTLVTVSS

SEQ ID NO: 1568 - protein, 117 aa, Artificial Sequence
  chemically synthesized
QVQLVQSGAEVKRPGASVKVSCKASGYTFTSFYMYWVRQAPGQGLEWMGIINPSDGSTSNAQKFQGRVTMTRDTSTSTVYMELSSLRSEDTAVYYCARRVAGDIFDIWGQGTMTVSS

SEQ ID NO: 1569 - protein, 119 aa, Artificial Sequence
  chemically synthesized
QVQLQESGPGLVKPSETLSLTCTVSGGSISSYHWNWIRQSPGKGLEWIGYIYYIGSTDYNPSLESRVTISVDTSKNQFSLKLSSVTAADTAVYYCARVPVGATGASDVWGQGTMVTVSS

SEQ ID NO: 1570 - protein, 121 aa, Artificial Sequence
  chemically synthesized
EVQLVESGGSVVRPGGSLRLSCVVSGFTFEDYGLSWVRQIPGKGLEWVSGISWTGGNTGYADSVKGRFTISRDNAKNSLYLQMNSLRAEDTALYHCTRDRQWLMQWYFDYWGQGTLVTVSS

SEQ ID NO: 1571 - protein, 119 aa, Artificial Sequence
  chemically synthesized
QVQLVESGGGVVQPGRSLRLSCSASGFTFSAYAMHWVRQAPGKGLEWVAAISYGGSDKYYADSVKGRFTISRDNSKNTLYLQMNSLRTDDTAVYYCAKSAHWNFFFDYWGQGTLVTVSS

SEQ ID NO: 1572 - protein, 121 aa, Artificial Sequence
  chemically synthesized
EVQLVESGGGLVQPGRSLRLSCVASGFALHDYAMHWVRQVPGKGLEWVSSISWNSGVIGYADSLKGRFTISRDNAKNSLYLQMNSLRAEDTALYYCAKGSGSYYVSWFDPWGQGTLVTVSS

SEQ ID NO: 1573 - protein, 123 aa, Artificial Sequence
  chemically synthesized
QLQLQESGPGLVQPSETLSLTCTVSGDSISSTAYHWDWIRQPPGKGLEWIGTITYNGNTYFNPSLKSRVTISVDTSKNQFSLKLLSMTAAETAVFYCARHLGYNSDFFPFDFWGQGTLVTVSS

SEQ ID NO: 1574 - protein, 119 aa, Artificial Sequence
  chemically synthesized
EVQLVESGGGLVRPGGSLRLSCAASGFTFSTYAMAWVRQTPGKGLEGVSAIGGSGDSTYYVDSVKGRFTISRDNSKSTLFLQMNSLRAEDTAVYYCVKVRNYDGSFDIWGQGTMVTVSS

SEQ ID NO: 1575 - protein, 108 aa, Artificial Sequence
  chemically synthesized
DIQMTQSPSSLSASVGDRVTITCRASQSISSYLIWYQQKPGTAPKFLIYAASSLQSGVPSRFSGCGSGTDFTLTISSLQPEDFATYYCQQSYSTPPITFGQGTRLEIK

SEQ ID NO: 1576 - protein, 107 aa, Artificial Sequence
  chemically synthesized
EIVMTQSPATLSVSPGERATLSCRASQSVSSNLAWYQQKPGQAPRLLIYGASTRATGIPARFSGSGSGTEFTLTISSLQSGDFAVYYCQQYNNWPLTFGGGTKVEIN

SEQ ID NO: 1577 - protein, 107 aa, Artificial Sequence; identical to SEQ ID NO: 1576
  chemically synthesized

SEQ ID NO: 1578 - protein, 108 aa, Artificial Sequence
  chemically synthesized
DIQMTQSPSSLSASVGDRVTITCRASQSINNYLNWYQQKPGKAPKLLIYTASSLQSGVPSRFSGSGSGTDFTLTISSLQPEDFATYYCQQSYSTPPLTFGQGTQLEIK

SEQ ID NO: 1579 - protein, 108 aa, Artificial Sequence
  chemically synthesized
DIQMTQSPSSLSASVGDRVTITCRASQSISNYLNWYQQKPGKAPKLLIYAASSLQSGVPSRFSGSGSGTDFTLTISSLQPEDFATYYCQQSYSTPPITFGQGTRLEIK

SEQ ID NO: 1580 - protein, 108 aa, Artificial Sequence
  chemically synthesized
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 1581 - protein, 108 aa, Artificial Sequence
  chemically synthesized
EIVLTQSPGTLSLSPGERVTLSCRASQSVYSNYLAWYQQNPGQAPRLLIYAASNRATGIPDRFSGSGSGTDFTLTISRLEPEDFAVYYCHQYATSPWTFGQGTKVEIK

SEQ ID NO: 1582 - protein, 108 aa, Artificial Sequence
  chemically synthesized
EIVLTQSPGTLSLSPGERATLSCRASQSVSSSYLAWYQQKPGQAPRLLIYGASSRTTGIPDRFSGSGSGTDFTLTISRLEPEDFAVYYCQQYGSSPWTFGQGTKVEIK

SEQ ID NO: 1583 - protein, 107 aa, Artificial Sequence
  chemically synthesized
DIQMTQSPISVSASVGDRVTITCRASQGISNWLAWYQQKPGIAPKLLIYSASSLQSGVPSRFRGSGSGTDFTLTIGSLQPEDFATYYCQQAHSFPLTFGGGTKVEIK

SEQ ID NO: 1584 - protein, 107 aa, Artificial Sequence
  chemically synthesized
DIQMTQSPSSLSASVGDRVTITCRASQGIRNDLGWYQQKPGKAPKRLIYAASNLQSGVPSRFSGSGSGTEFTLTISSLQPEDFATYYCLQHNSYPLTFGGGTKVEIK

SEQ ID NO: 1585 - protein, 107 aa, Artificial Sequence [sequence omitted]

SEQ ID NO: 1586 - protein, 108 aa, Artificial Sequence
  chemically synthesized
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 1587 - protein, 108 aa, Artificial Sequence; identical to SEQ ID NO: 1580
  chemically synthesized

SEQ ID NO: 1588 - protein, 444 aa, Artificial Sequence
  chemically synthesized
EVQLLESGGVLVQPGGSLRLSCAASGFTFSNFGMTWVRQAPGKGLEWVSGISGGGRDTYFADSVKGRFTISRDNSKNTLYLQMNSLKGEDTAVYYCVKWGNIYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1589 - protein, 449 aa, Artificial Sequence
  chemically synthesized
EVQVVESGGGLVEPGRSLRLSCKASGFTFDDYAMHWVRQTPGKALEWVSGISWSGNNIGYADSVKGRFTISKDDAKNSLYLQMNSLRPEDTALYYCTKDISITGTLDAFDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1590 - protein, 446 aa, Artificial Sequence
  chemically synthesized
EVQLVESGGGLVRPGGSLRLSCAASGFTFSTYAMAWVRQTPGKGLEGVSAIGGSGDSTYYVDSVKGRFTISRDNSKSTLFLQMNSLRAEDTAVYYCVKVRNYDGSFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1591 - protein, 448 aa, Artificial Sequence
  chemically synthesized
QVQLVQSGAEVKRPGSSVKVSCKVSGVTFRNFAIIWVRQAPGQGLEWMGGIIPFFSAANYAQSFQGRVTITPDESTSTAFMELASLRSEDTAVYYCAREGERGHTYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1592 - protein, 214 aa, Artificial Sequence
  chemically synthesized
DIQMTQSPSSLSASVGDSITITCRASLSINTFLNWYQQKPGKAPNLLIYAASSLHGGVPSRFSGSGSGTDFTLTIRTLQPEDFATYYCQQSSNTPFTFGPGTVVDFRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1593 - protein, 214 aa, Artificial Sequence
  chemically synthesized
DIQMTQSPISVSASVGDRVTITCRASQGISNWLAWYQQKPGIAPKLLIYSASSLQSGVPSRFRGSGSGTDFTLTIGSLQPEDFATYYCQQAHSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1594 - protein, 215 aa, Artificial Sequence
  chemically synthesized
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1595 - protein, 215 aa, Artificial Sequence
  chemically synthesized
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1596 - protein, 16 aa, Artificial Sequence
  chemically synthesized
GVNPSNGGTNFSEKFK

SEQ ID NO: 1597 - protein, 6 aa, Artificial Sequence
  chemically synthesized
YPGTGG

SEQ ID NO: 1598 - protein, 8 aa, Artificial Sequence
  chemically synthesized
WTTGTGAY

SEQ ID NO: 1599 - protein, 13 aa, Artificial Sequence
  chemically synthesized
SQSLLDSGNQKNF

SEQ ID NO: 1600 - protein, 3 aa, Artificial Sequence
  chemically synthesized
WAS

SEQ ID NO: 1601 - protein, 6 aa, Artificial Sequence
  chemically synthesized
DYSYPY

SEQ ID NO: 1602 - protein, 5 aa, Artificial Sequence
  chemically synthesized
TYWMH

SEQ ID NO: 1603 - protein, 16 aa, Artificial Sequence
  chemically synthesized
NIYPGTGGSNFDEKFK

SEQ ID NO: 1604 - protein, 7 aa, Artificial Sequence
  chemically synthesized
WASTRES

SEQ ID NO: 1605 - protein, 9 aa, Artificial Sequence
  chemically synthesized
QNDYSYPYT

SEQ ID NO: 1606 - protein, 10 aa, Artificial Sequence
  chemically synthesized
GYTFTTYWMH

SEQ ID NO: 1607 - protein, 8 aa, Artificial Sequence
  chemically synthesized
GFTFSSYT

SEQ ID NO: 1608 - protein, 8 aa, Artificial Sequence
  chemically synthesized
ISDTGGNT

SEQ ID NO: 1609 - protein, 14 aa, Artificial Sequence
  chemically synthesized
AKDQGGSYPYYFHY

SEQ ID NO: 1610 - protein, 6 aa, Artificial Sequence
  chemically synthesized
QSISSY

SEQ ID NO: 1611 - protein, 3 aa, Artificial Sequence
  chemically synthesized
AAS

SEQ ID NO: 1612 - protein, 10 aa, Artificial Sequence
  chemically synthesized
QQSYSTPPIT

SEQ ID NO: 1613 - protein, 8 aa, Artificial Sequence
  chemically synthesized
GFTVSNNY

SEQ ID NO: 1614 - protein, 7 aa, Artificial Sequence
  chemically synthesized
IYSGGFT

SEQ ID NO: 1615 - protein, 16 aa, Artificial Sequence
  chemically synthesized
ARYYYDTSDYWTFFDY

SEQ ID NO: 1616 - protein, 6 aa, Artificial Sequence
  chemically synthesized
QSVSSN

SEQ ID NO: 1617 - protein, 3 aa, Artificial Sequence
  chemically synthesized
GAS

SEQ ID NO: 1618 - protein, 9 aa, Artificial Sequence
  chemically synthesized
QQYNNWPLT

SEQ ID NO: 1619 - protein, 8 aa, Artificial Sequence
  chemically synthesized
GFTFSSYG

SEQ ID NO: 1620 - protein, 8 aa, Artificial Sequence
  chemically synthesized
IWYDGSNI

SEQ ID NO: 1621 - protein, 12 aa, Artificial Sequence
  chemically synthesized
ARPGHWNYFFEY

SEQ ID NO: 1622 - protein, 6 aa, Artificial Sequence
  chemically synthesized
QSINNY

SEQ ID NO: 1623 - protein, 3 aa, Artificial Sequence
  chemically synthesized
TAS

SEQ ID NO: 1624 - protein, 10 aa, Artificial Sequence
  chemically synthesized
QQSYSTPPLT

SEQ ID NO: 1625 - protein, 8 aa, Artificial Sequence
  chemically synthesized
GFTFRNYD

SEQ ID NO: 1626 - protein, 7 aa, Artificial Sequence
  chemically synthesized
IGSAGDT

SEQ ID NO: 1627 - protein, 16 aa, Artificial Sequence
  chemically synthesized
TRDIHCSSTRCYGMDV

SEQ ID NO: 1628 - protein, 6 aa, Artificial Sequence
  chemically synthesized
QSISNY

SEQ ID NO: 1629 - protein, 8 aa, Artificial Sequence
  chemically synthesized
GFKFSNEW

SEQ ID NO: 1630 - protein, 10 aa, Artificial Sequence
  chemically synthesized
IKSKTDGGTT

SEQ ID NO: 1631 - protein, 21 aa, Artificial Sequence
  chemically synthesized
TTDQDFWSGYYTGADYYGMDV

SEQ ID NO: 1632 - protein, 8 aa, Artificial Sequence
  chemically synthesized
GGSLNGYY

SEQ ID NO: 1633 - protein, 7 aa, Artificial Sequence
  chemically synthesized
IDHSGST

SEQ ID NO: 1634 - protein, 10 aa, Artificial Sequence
  chemically synthesized
AREGLLPFDY

SEQ ID NO: 1635 - protein, 7 aa, Artificial Sequence
  chemically synthesized
QSVYSNY

SEQ ID NO: 1636 - protein, 9 aa, Artificial Sequence
  chemically synthesized
HQYATSPWT

SEQ ID NO: 1637 - protein, 10 aa, Artificial Sequence
  chemically synthesized
DDSISSTTYY

SEQ ID NO: 1638 - protein, 15 aa, Artificial Sequence
  chemically synthesized
ARHLGYNGNWYPFDF

SEQ ID NO: 1639 - protein, 7 aa, Artificial Sequence
  chemically synthesized
QSVSSSY

SEQ ID NO: 1640 - protein, 3 aa, Artificial Sequence
  chemically synthesized
GAS

SEQ ID NO: 1641 - protein, 9 aa, Artificial Sequence
  chemically synthesized
QQYGSSPWT

SEQ ID NO: 1642 - protein, 8 aa, Artificial Sequence
  chemically synthesized
GFTFDDYA

SEQ ID NO: 1643 - protein, 8 aa, Artificial Sequence
  chemically synthesized
INWSGNNI

SEQ ID NO: 1644 - protein, 15 aa, Artificial Sequence
  chemically synthesized
TKDISITGTLDAFDV

SEQ ID NO: 1645 - protein, 6 aa, Artificial Sequence
  chemically synthesized
QGISNW

SEQ ID NO: 1646 - protein, 3 aa, Artificial Sequence
  chemically synthesized
SAS

SEQ ID NO: 1647 - protein, 9 aa, Artificial Sequence
  chemically synthesized
QQAHSFPLT

SEQ ID NO: 1648 - protein, 8 aa, Artificial Sequence
  chemically synthesized
IWSDGDSE

SEQ ID NO: 1649 - protein, 9 aa, Artificial Sequence
  chemically synthesized
ARDRDLEDI

SEQ ID NO: 1650 - protein, 6 aa, Artificial Sequence
  chemically synthesized
QGIRND

SEQ ID NO: 1651 - protein, 9 aa, Artificial Sequence
  chemically synthesized
LQHNSYPLT

SEQ ID NO: 1652 - protein, 8 aa, Artificial Sequence
  chemically synthesized
GFTFSNFG

SEQ ID NO: 1653 - protein, 8 aa, Artificial Sequence
  chemically synthesized
ISGGGRDT

SEQ ID NO: 1654 - protein, 10 aa, Artificial Sequence
  chemically synthesized
VKWGNIYFDY

SEQ ID NO: 1655 - protein, 6 aa, Artificial Sequence
  chemically synthesized
LSINTF

SEQ ID NO: 1656 - protein, 9 aa, Artificial Sequence
  chemically synthesized
QQSSNTPFT

SEQ ID NO: 1657 - protein, 8 aa, Artificial Sequence
  chemically synthesized
GFTFDDYG

SEQ ID NO: 1658 - protein, 8 aa, Artificial Sequence
  chemically synthesized
ISWNDGKT

SEQ ID NO: 1659 - protein, 14 aa, Artificial Sequence
  chemically synthesized
ARDWQYLIERYFDY

SEQ ID NO: 1660 - protein, 8 aa, Artificial Sequence
  chemically synthesized
IGWTGGRS

SEQ ID NO: 1661 - protein, 14 aa, Artificial Sequence
  chemically synthesized
ARDRQWLVQWYFDY

SEQ ID NO: 1662 - protein, 14 aa, Artificial Sequence
  chemically synthesized
ARDWQYLIDRYFDF

SEQ ID NO: 1663 - protein, 8 aa, Artificial Sequence
  chemically synthesized
IGWSSGSI

SEQ ID NO: 1664 - protein, 14 aa, Artificial Sequence
  chemically synthesized
AKAYTFMITLYFDY

SEQ ID NO: 1665 - protein, 8 aa, Artificial Sequence
  chemically synthesized
GFTFDDYD

SEQ ID NO: 1666 - protein, 8 aa, Artificial Sequence
  chemically synthesized
SGWNRGSL

SEQ ID NO: 1667 - protein, 14 aa, Artificial Sequence
  chemically synthesized
AKGFVVVSAAYFDY

SEQ ID NO: 1668 - protein, 8 aa, Artificial Sequence
  chemically synthesized
GVTFRNFA

SEQ ID NO: 1669 - protein, 8 aa, Artificial Sequence
  chemically synthesized
IIPFFSAA

SEQ ID NO: 1670 - protein, 14 aa, Artificial Sequence
  chemically synthesized
AREGERGHTYGFDY

SEQ ID NO: 1671 - protein, 8 aa, Artificial Sequence
  chemically synthesized
INWNRGRT

SEQ ID NO: 1672 - protein, 14 aa, Artificial Sequence
  chemically synthesized
AKAEQWLDEGYFDY

SEQ ID NO: 1673 - protein, 8 aa, Artificial Sequence
  chemically synthesized
GFTFEDYA

SEQ ID NO: 1674 - protein, 8 aa, Artificial Sequence
  chemically synthesized
ISDSGGST

SEQ ID NO: 1675 - protein, 8 aa, Artificial Sequence
  chemically synthesized
GYTFTSFY

SEQ ID NO: 1676 - protein, 8 aa, Artificial Sequence
  chemically synthesized
IGWSNVKI

SEQ ID NO: 1677 - protein, 14 aa, Artificial Sequence
  chemically synthesized
VKAYTSMLTLYFDY

SEQ ID NO: 1678 - protein, 8 aa, Artificial Sequence
  chemically synthesized
GGSISSYH

SEQ ID NO: 1679 - protein, 8 aa, Artificial Sequence
  chemically synthesized
INPSDGST

SEQ ID NO: 1680 - protein, 11 aa, Artificial Sequence
  chemically synthesized
ARRVAGDIFDI

SEQ ID NO: 1681 - protein, 8 aa, Artificial Sequence
  chemically synthesized
GFTFEDYG

SEQ ID NO: 1682 - protein, 7 aa, Artificial Sequence
  chemically synthesized
IYYIGST

SEQ ID NO: 1683 - protein, 13 aa, Artificial Sequence
  chemically synthesized
ARVPVGATGASDV

SEQ ID NO: 1684 - protein, 8 aa, Artificial Sequence
  chemically synthesized
GFTFSAYA

SEQ ID NO: 1685 - protein, 8 aa, Artificial Sequence
  chemically synthesized
ISWTGGNT

SEQ ID NO: 1686 - protein, 14 aa, Artificial Sequence
  chemically synthesized
TRDRQWLMQWYFDY

SEQ ID NO: 1687 - protein, 8 aa, Artificial Sequence
  chemically synthesized
GFALHDYA

SEQ ID NO: 1688 - protein, 8 aa, Artificial Sequence
  chemically synthesized
ISYGGSDK

SEQ ID NO: 1689 - protein, 12 aa, Artificial Sequence
  chemically synthesized
AKSAHWNFFFDY

SEQ ID NO: 1690 - protein, 8 aa, Artificial Sequence
  chemically synthesized
GFTFSTYA

SEQ ID NO: 1691 - protein, 7 aa, Artificial Sequence
  chemically synthesized
ITYNGNT

SEQ ID NO: 1692 - protein, 15 aa, Artificial Sequence
  chemically synthesized
ARHLGYNSDFFPFDF

SEQ ID NO: 1693 - protein, 8 aa, Artificial Sequence
  chemically synthesized
IGGSGDST

SEQ ID NO: 1694 - protein, 12 aa, Artificial Sequence
  chemically synthesized
VKVRNYDGSFDI

SEQ ID NO: 1695 - protein, 8 aa, Artificial Sequence
  chemically synthesized
LSGRSANP

SEQ ID NO: 1696 - protein, 8 aa, Artificial Sequence
  chemically synthesized
LSGRSANI

SEQ ID NO: 1697 - protein, 8 aa, Artificial Sequence
  chemically synthesized
LSGRSDNI

SEQ ID NO: 1698 - protein, 8 aa, Artificial Sequence
  chemically synthesized
MIAPVAYR

SEQ ID NO: 1699 - protein, 8 aa, Artificial Sequence
  chemically synthesized
RPSPMWAY

SEQ ID NO: 1700 - protein, 8 aa, Artificial Sequence
  chemically synthesized
WATPRPMR

SEQ ID NO: 1701 - protein, 8 aa, Artificial Sequence
  chemically synthesized
FRLLDWQW

SEQ ID NO: 1702 - protein, 5 aa, Artificial Sequence
  chemically synthesized
ISSGL

SEQ ID NO: 1703 - protein, 7 aa, Artificial Sequence
  chemically synthesized
ISSGLLS

SEQ ID NO: 1704 - protein, 6 aa, Artificial Sequence
  chemically synthesized
ISSGLL

SEQ ID NO: 1705 - protein, 8 aa, Artificial Sequence
  chemically synthesized
GITFSNSG

SEQ ID NO: 1706 - protein, 8 aa, Artificial Sequence
  chemically synthesized
IWYDGSKR

SEQ ID NO: 1707 - protein, 5 aa, Artificial Sequence
  chemically synthesized
TNDDY

SEQ ID NO: 1708 - protein, 6 aa, Artificial Sequence
  chemically synthesized
QSVSSY

SEQ ID NO: 1709 - protein, 3 aa, Artificial Sequence
  chemically synthesized
DAS

SEQ ID NO: 1710 - protein, 9 aa, Artificial Sequence
  chemically synthesized
QQSSNWPRT

SEQ ID NO: 1711 - protein, 8 aa, Artificial Sequence
  chemically synthesized
GYTFTNYY

SEQ ID NO: 1712 - protein, 8 aa, Artificial Sequence
  chemically synthesized
INPSNGGT

SEQ ID NO: 1713 - protein, 12 aa, Artificial Sequence
  chemically synthesized
RRDYRFDMGFDY

SEQ ID NO: 1714 - protein, 10 aa, Artificial Sequence
  chemically synthesized
KGVSTSGYSY

SEQ ID NO: 1715 - protein, 3 aa, Artificial Sequence
  chemically synthesized
LAS

SEQ ID NO: 1716 - protein, 9 aa, Artificial Sequence
  chemically synthesized
QHSRDLPLT

SEQ ID NO: 1717 - protein, 8 aa, Artificial Sequence
  chemically synthesized
ISWNSGVI

SEQ ID NO: 1718 - protein, 14 aa, Artificial Sequence
  chemically synthesized
AKGSGSYYVSWFDP

SEQ ID NO: 1719 - protein, 118 aa, Artificial Sequence
  chemically synthesized
EVKLVESGGGLVKPGGSLKLSCAASGFTFSSYGMSWLRQTPEKRLEWVATMSGGGRDIYYPDSMKGRFTISRDNAKNNLYLQMSSLRSEDTALYYCARQYYDDWFAYWGQGTLVTVSA

SEQ ID NO: 1720 - protein, 122 aa, Artificial Sequence
  chemically synthesized
QVQLKQSGPGLVQPSQNLSVTCTVSGFSLTTYGVHWVRQSPGKGLEWLGVIWSGGSTDYNAAFISRLTISKDNARSQVFFKMNSLQVNDTAMYYCAREKSVYGNYVGAMDYWGQGTSVTVSS

SEQ ID NO: 1721 - protein, 118 aa, Artificial Sequence
  chemically synthesized
EVKLVESGGGLVKPGGSLKLSCGASGFTFSSYGMSWVRQTPEKRLEWVATISGGGRDIYYPDSVKGRLTISRDNAKNNLYLQMSSLRSEDTALYYCVRQYYDDWFAYWGQGTLVTVSA

SEQ ID NO: 1722 - protein, 120 aa, Artificial Sequence
  chemically synthesized
DVQLQESGPGLVKPSQSLSLTCTVTGYSITSDYAWNWIRQFPGNQLEWMAYISYSGYTSYNPSLKSRISITRDTSKNQFFLQLNSVTTEDTATYYCARSLDYDYGTMDYWGQGTSVTVSS

SEQ ID NO: 1723 - protein, 117 aa, Artificial Sequence
  chemically synthesized
EVKLVESGGGLVKPGGSLKLSCAASGFAFRSYDMSWVRQTPEKILEWVATISGGGSYTYYQDSVKGRFTISRDNARNTLYLQMSSLRSEDTALYYCASPYGPYFDYWGQGTTLTVSS

SEQ ID NO: 1724 - protein, 120 aa, Artificial Sequence
  chemically synthesized
DVQLQESGPGLVKPSQSLSLTCTVTGYSITSDYAWNWIRQFPGNQLEWMAYISYSGYTSYNPSLKSRISITRDTSRNQFFLQLNSVTTEDTATYYCARSLDYDYGTMDYWGQGTSVTVSS

SEQ ID NO: 1725 - protein, 117 aa, Artificial Sequence
  chemically synthesized
EVKLVESGGGLVKPGGSLKLSCSASGFSFSYYDMSWVRQTPEKGLEWVATISGGGRNTYFIDSVKGRFTISRDNVKNNLYLLMSSLRSEDTALYYCASPYEGAVDFWGQGTSVTVSS

SEQ ID NO: 1726 - protein, 117 aa, Artificial Sequence
  chemically synthesized
EVKLVESGGGLVKPGGSLKLSCAASGFTFSSYGMSWVRQTPEKRLEWATISGGGRDTYYLDSVKGRFTISRDNAKNNLYLQMSSLRSEDTALYYCVRQYYDDWFAYWGQGTLVSNSA

SEQ ID NO: 1727 - protein, 120 aa, Artificial Sequence
  chemically synthesized
QVQLQQSGDELVRPGTSVKMSCKAAGYTFTNNWIGWVKQRPGHGLEWIGDFYPGGGYTNYNEKFKGKATLTADTSSSTAYMQLSSLTSEDSAIYYCARGYGTNYWYFDVWGAGTTVTVSS

SEQ ID NO: 1728 - protein, 114 aa, Artificial Sequence
  chemically synthesized
QIHLVQSGPELKKPGETVKISCKASGYTFTNFGMNWVKQAPGKGLKWMGWISGYTREPTYAADFKGRFAISLETSASTAYLQINDLKNEDMATYFCARDVFDYWGQGTTLTVSS

SEQ ID NO: 1729 - protein, 114 aa, Artificial Sequence
  chemically synthesized
QIQLVQSGSELKKPGASVKVSCKASGYTFTNFGMNWVRQAPGQGLKWMGWISGYTREPTYAADFKGRFVISLDTSVSTAYLQISSLKAEDTAVYYCARDVFDYWGQGTLVTVSS

SEQ ID NO: 1730 - protein, 120 aa, Artificial Sequence
  chemically synthesized
QVQLQESGPGLVKPSQTLSLTCTVSGYSISSDYAWNWIRQPPGKGLEWMAYISYSGYTSYNPSLKSRITISRDTSKNQFSLKLSSVTAADTAVYYCARSLDYDYGTMDYWGQGTLVTVSS

SEQ ID NO: 1731 - protein, 108 aa, Artificial Sequence
  chemically synthesized
DIVLTQTPATLSVTPGDSVSLSCRASQSISNNLHWYQQKSHESPRLLIKYASQSISGIPSRFSGSGSGTDFTLNINSVETEDFGMYFCQQSNSWPLTFGAGTKLELKR

SEQ ID NO: 1732 - protein, 108 aa, Artificial Sequence
  chemically synthesized
SIVMTQTPKFLLVSAGDRVTITCKASQSVSDDVAWYQQKPGQSPKLLIYYAFNRYTGVPDRFTGSGYGTDFTFTISTVQSEDLAVYFCQQDYRSPWTFGGGTKLEIKR

SEQ ID NO: 1733 - protein, 108 aa, Artificial Sequence
  chemically synthesized
DIVLTQSPATLSVTPGDSVSLSCRASQSISNDLHWYQQKSHESPRLLIKYVSQSISGIPSRFSGSGSGTDFTLSINSVETEDFGMYFCQQSDSWPLTFGAGTKLELKR

SEQ ID NO: 1734 - protein, 107 aa, Artificial Sequence
  chemically synthesized
QIVLSQSPAILSASPGEKVTMTCRANSSVSSMHWYQQKPGSSPEPWIYAISNLAFGVPTRFSGSGSGTSYSLTISRVEAEDAATYFCQQWSSRPPTFGGGTKLEIKR

SEQ ID NO: 1735 - protein, 108 aa, Artificial Sequence
  chemically synthesized
DIQMNQSPSSLSASLGDTITITCHASQSINVWLSWYQQKPGNIPKLLIYRASNLHTGVPSRFSGSGSGTGFTLTISSLQPDDIATYYCQQGQSYPWTFGGGTKLEIKR

SEQ ID NO: 1736 - protein, 107 aa, Artificial Sequence
  chemically synthesized
QIVLSQSPAILSASPGEKVTMTCRANSSVSSMHWYQQKPGSSPEPWIYAISNLAFGVPARFSGSGSGTSYSLTISRVEAEDAATYFCQQWNSRPPTFGGGTKLEIKR

SEQ ID NO: 1737 - protein, 108 aa, Artificial Sequence
  chemically synthesized
DIVMTQSHKVMSTSVGDRVSITCKASQDVDNAVAWYQQNPGQSPKLLIKWASTRHHGVPDRFTGSGSGTDFTLTISTVQSEDLADFFCQQYSTFPYTFGGGTKLEIKR

SEQ ID NO: 1738 - protein, 108 aa, Artificial Sequence
  chemically synthesized
DIVLTQTPATLSVTPGDSVSLSCRASQSLSNNLHWYQQKSHESPRLLIKYASQSISGIPSRFSGSGSGTDFTLSINSVETEDFGMYFCQQSNSWPLTFGAGTKLEMKR

SEQ ID NO: 1739 - protein, 108 aa, Artificial Sequence
  chemically synthesized
NIVMTQTPKILFISAGDRVTITCKASQSVSNDVAWYQQKPGQSPKLLIYYAFTRYIGVPDRFTGSGYGTDFTFTISTVQAEDLAVYFCQQDYSSPYTFGGGTKLEIKR

SEQ ID NO: 1740 - protein, 111 aa, Artificial Sequence
  chemically synthesized
DIVLTQSPASLAVSLGQRATISCRASESVDNYGYSFMNWFQQKPGQPPKLLIYRASNLESGIPARFSGSGSRTNFTLTINPVEADDVATYFCQQSNADPTFGGGTNLEIKR

SEQ ID NO: 1741 - protein, 110 aa, Artificial Sequence
  chemically synthesized
DIVLTQSPASLAVSPGQRATITCRASESVDNYGYSFMNWFQQKPGQPPKLLIYRASNLESGVPARFSGSGSRTDFTLTINPVEANDTANYYCQQSNADPTFGQGTKLEIK

SEQ ID NO: 1742 - protein, 106 aa, Artificial Sequence
  chemically synthesized
EIVLTQSPATLSLSPGERATLSCRANSSVSSMHWYQQKPGQSPEPWIYAISNLAFGVPARFSGSGSGTDYTLTISSLEPEDFAVYYCQQWSSRPPTFGQGTKLEIK

SEQ ID NO: 1743 - protein, 122 aa, Artificial Sequence
  chemically synthesized
QVQLVQSGSEVKKSGSSVKVSCKTSGGTFSITNYAINWVRQAPGQGLEWMGGILPIFGAAKYAQKFQDRVTITADESTNTAYLELSSLTSEDTAMYYCARGKRWLQSDLQYWGQGTLVTVSS

SEQ ID NO: 1744 - protein, 110 aa, Artificial Sequence
  chemically synthesized
QPVLTQPASVSGSPGQSITISCTGSSSDVGSYDLVSWYQQSPGKVPKLLIYEGVKRPSGVSNRFSGSKSGNTASLTISGLQAEDEADYYCSSYAGTRNFVFGGGTQLTVL

SEQ ID NO: 1745 - protein, 120 aa, Artificial Sequence
  chemically synthesized
QVQLVQSGAEVKKPGASVKVSCKASGYTFTNYYMYWVKQAPGQGLEWIGGINPSNGGTNYNEKFKNKATLTADKSTSTAYMELSSLRSEDTAVYYCTRRDYRYDMGFDYWGQGTTVTVSS

SEQ ID NO: 1746 - protein, 120 aa, Artificial Sequence
  chemically synthesized
QVQLVQSGAEVKKPGASVKVSCKASGYTFTSYYMYWVRQAPGQGLEWMGGVNPSNGGTNFNEKFKSRVTITADKSTSTAYMELSSLRSEDTAVYYCARRDYRYDMGFDYWGQGTTVTVSS

SEQ ID NO: 1747 - protein, 120 aa, Artificial Sequence
  chemically synthesized
EVQLQQSGPELVKPGASVKISCKASGYTFTNYYMYWVKQSHGKSLEWIGGINPSNGGTNYNEKFKNKATLTVDKSSSTAYMELNSLTSEDSAVYYCARRDYRYDMGFDYWGAGTTVTVSS

SEQ ID NO: 1748 - protein, 120 aa, Artificial Sequence
  chemically synthesized
EVQLQQSGPVLVKPGASVKMSCKASGYTFTSYYMYWVKQSHGKSLEWIGGVNPSNGGTNFNEKFKSKATLTVDKSSSTAYMELNSLTSEDSAVYYCARRDYRYDMGFDYWGQGTTLTVSS

SEQ ID NO: 1749 - protein, 111 aa, Artificial Sequence
  chemically synthesized
EIVLTQSPATLSLSPGERATISCRASKGVSTSGYSYLHWYQQKPGQAPRLLIYLASYLESGVPARFSGSGSGTDFTLTISSLEPEDFATYYCQHSRELPLTFGTGTKVEIK

SEQ ID NO: 1750 - protein, 111 aa, Artificial Sequence
  chemically synthesized
QIVLTQSPAIMSASPGEKVTMTCRASKGVSTSGYSYLHWYQQKPGSSPRLLIYLASYLESGVPVRFSGSGSGTSYSLTISRMEAEDAATYYCQHSRELPLTFGTGTRLEIK

SEQ ID NO: 1751 - protein, 5 aa, Artificial Sequence
  chemically synthesized
SYGMS

SEQ ID NO: 1752 - protein, 17 aa, Artificial Sequence
  chemically synthesized
TMSGGGRDIYYPDSMKG

SEQ ID NO: 1753 - protein, 9 aa, Artificial Sequence
  chemically synthesized
QYYDDWFAY

SEQ ID NO: 1754 - protein, 11 aa, Artificial Sequence
  chemically synthesized
RASQSISNNLH

SEQ ID NO: 1755 - protein, 7 aa, Artificial Sequence
  chemically synthesized
YASQSIS

SEQ ID NO: 1756 - protein, 9 aa, Artificial Sequence
  chemically synthesized
QQSNSWPLT

SEQ ID NO: 1757 - protein, 5 aa, Artificial Sequence
  chemically synthesized
TYGVH

SEQ ID NO: 1758 - protein, 16 aa, Artificial Sequence
  chemically synthesized
VIWSGGSTDYNAAFIS

SEQ ID NO: 1759 - protein, 14 aa, Artificial Sequence
  chemically synthesized
EKSVYGNYVGAMDY

SEQ ID NO: 1760 - protein, 11 aa, Artificial Sequence
  chemically synthesized
KASQSVSDDVA

SEQ ID NO: 1761 - protein, 7 aa, Artificial Sequence
  chemically synthesized
YAFNRYT

SEQ ID NO: 1762 - protein, 9 aa, Artificial Sequence
  chemically synthesized
QQDYRSPWT

SEQ ID NO: 1763 - protein, 17 aa, Artificial Sequence
  chemically synthesized
TISGGGRDIYYPDSVKG

SEQ ID NO: 1764 - protein, 11 aa, Artificial Sequence
  chemically synthesized
RASQSISNDLH

SEQ ID NO: 1765 - protein, 7 aa, Artificial Sequence
  chemically synthesized
YVSQSIS

SEQ ID NO: 1766 - protein, 9 aa, Artificial Sequence
  chemically synthesized
QQSDSWPLT

SEQ ID NO: 1767 - protein, 6 aa, Artificial Sequence
  chemically synthesized
SDYAWN

SEQ ID NO: 1768 - protein, 16 aa, Artificial Sequence
  chemically synthesized
YISYSGYTSYNPSLKS

SEQ ID NO: 1769 - protein, 11 aa, Artificial Sequence
  chemically synthesized
SLDYDYGTMDY

SEQ ID NO: 1770 - protein, 10 aa, Artificial Sequence
  chemically synthesized
RANSSVSSMH

SEQ ID NO: 1771 - protein, 7 aa, Artificial Sequence
  chemically synthesized
AISNLAF

SEQ ID NO: 1772 - protein, 9 aa, Artificial Sequence
  chemically synthesized
QQWSSRPPT

SEQ ID NO: 1773 - protein, 5 aa, Artificial Sequence
  chemically synthesized
SYDMS

SEQ ID NO: 1774 - protein, 17 aa, Artificial Sequence
  chemically synthesized
TISGGGSYTYYQDSVKG

SEQ ID NO: 1775 - protein, 8 aa, Artificial Sequence
  chemically synthesized
PYGPYFDY

SEQ ID NO: 1776 - protein, 11 aa, Artificial Sequence
  chemically synthesized
HASQSINVWLS

SEQ ID NO: 1777 - protein, 6 aa, Artificial Sequence
  chemically synthesized
ASNLHT

SEQ ID NO: 1778 - protein, 9 aa, Artificial Sequence
  chemically synthesized
QQGQSYPWT

SEQ ID NO: 1779 - protein, 9 aa, Artificial Sequence
  chemically synthesized
QQWNSRPPT

SEQ ID NO: 1780 - protein, 5 aa, Artificial Sequence
  chemically synthesized
YYDMS

SEQ ID NO: 1781 - protein, 17 aa, Artificial Sequence
  chemically synthesized
TISGGGRNTYFIDSVKG

SEQ ID NO: 1782 - protein, 8 aa, Artificial Sequence
  chemically synthesized
PYEGAVDF

SEQ ID NO: 1783 - protein, 11 aa, Artificial Sequence
  chemically synthesized
KASQDVDNAVA

SEQ ID NO: 1784 - protein, 7 aa, Artificial Sequence
  chemically synthesized
WASTRHH

SEQ ID NO: 1785 - protein, 9 aa, Artificial Sequence
  chemically synthesized
QQYSTFPYT

SEQ ID NO: 1786 - protein, 17 aa, Artificial Sequence
  chemically synthesized
TISGGGRDTYYLDSVKG

SEQ ID NO: 1787 - protein, 11 aa, Artificial Sequence
  chemically synthesized
RASQSLSNNLH

SEQ ID NO: 1788 - protein, 5 aa, Artificial Sequence
  chemically synthesized
NNWIG

SEQ ID NO: 1789 - protein, 17 aa, Artificial Sequence
  chemically synthesized
DFYPGGGYTNYNEKFKG

SEQ ID NO: 1790 - protein, 11 aa, Artificial Sequence
  chemically synthesized
GYGTNYWYFDV

SEQ ID NO: 1791 - protein, 11 aa, Artificial Sequence
  chemically synthesized
KASQSVSNDVA

SEQ ID NO: 1792 - protein, 7 aa, Artificial Sequence
  chemically synthesized
YAFTRYI

SEQ ID NO: 1793 - protein, 9 aa, Artificial Sequence
  chemically synthesized
QQDYSSPYT

SEQ ID NO: 1794 - protein, 5 aa, Artificial Sequence
  chemically synthesized
NFGMN

SEQ ID NO: 1795 - protein, 17 aa, Artificial Sequence
  chemically synthesized
WISGYTREPTYAADFKG

SEQ ID NO: 1796 - protein, 5 aa, Artificial Sequence
  chemically synthesized
DVFDY

SEQ ID NO: 1797 - protein, 15 aa, Artificial Sequence
  chemically synthesized
RASESVDNYGYSFMN

SEQ ID NO: 1798 - protein, 7 aa, Artificial Sequence
  chemically synthesized
RASNLES

SEQ ID NO: 1799 - protein, 8 aa, Artificial Sequence
  chemically synthesized
QQSNADPT

SEQ ID NO: 1800 - protein, 10 aa, Artificial Sequence
  chemically synthesized
GYTFTSYYMY

SEQ ID NO: 1801 - protein, 17 aa, Artificial Sequence
  chemically synthesized
GVNPSNGGTNFNEKFKS

SEQ ID NO: 1802 - protein, 11 aa, Artificial Sequence
  chemically synthesized
RDYRYDMGFDY

SEQ ID NO: 1803 - protein, 15 aa, Artificial Sequence
  chemically synthesized
RASKGVSTSGYSYLH

SEQ ID NO: 1804 - protein, 6 aa, Artificial Sequence
  chemically synthesized
LASYLE

SEQ ID NO: 1805 - protein, 9 aa, Artificial Sequence
  chemically synthesized
QHSRELPLT

SEQ ID NO: 1806 - protein, 10 aa, Artificial Sequence
  chemically synthesized
GYTFTNYYMY

SEQ ID NO: 1807 - protein, 329 aa, Artificial Sequence
  chemically synthesized
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1808 - protein, 254 aa, Artificial Sequence
  chemically synthesized
ACRICQDHPATKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1809 - protein, 261 aa, Artificial Sequence
  chemically synthesized
QGQSGQGACRICQDHPATKWNSGGGSSGGSISSGLLSGRSDNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1810 - protein, 254 aa, Artificial Sequence
  chemically synthesized
ACRICQDHPATKWNSGGGSSGGSISSGLLSGRSDNPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1811 - protein, 261 aa, Artificial Sequence
  chemically synthesized
QGQSGQGACRICQDHPATKWNSGGGSSGGSISSGLLSGRSDNPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1812 - protein, 254 aa, Artificial Sequence
  chemically synthesized
ACRICQDHPATKWNSGGGSSGGSISSGLLSGRSANPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1813 - protein, 261 aa, Artificial Sequence
  chemically synthesized
QGQSGQGACRICQDHPATKWNSGGGSSGGSISSGLLSGRSANPGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1814 - protein, 254 aa, Artificial Sequence
  chemically synthesized
ACRICQDHPATKWNSGGGSSGGSISSGLLSGRSGNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1815 - protein, 261 aa, Artificial Sequence
  chemically synthesized
QGQSGQGACRICQDHPATKWNSGGGSSGGSISSGLLSGRSGNHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1816 - protein, 256 aa, Artificial Sequence
  chemically synthesized
ACRICQDHPATKWNSGGGSSGGSISSGLLSGRSANPRGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1817 - protein, 263 aa, Artificial Sequence
  chemically synthesized
QGQSGQGACRICQDHPATKWNSGGGSSGGSISSGLLSGRSANPRGGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1818 - protein, 254 aa, Artificial Sequence
  chemically synthesized
ACRICQDHPATKWNSGGGSSGGSISSGLLSGRSDDHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1819 - protein, 261 aa, Artificial Sequence
  chemically synthesized
QGQSGQGACRICQDHPATKWNSGGGSSGGSISSGLLSGRSDDHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1820 - protein, 254 aa, Artificial Sequence
  chemically synthesized
ACRICQDHPATKWNSGGGSSGGSISSGLLSGRSDIHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1821 - protein, 261 aa, Artificial Sequence
  chemically synthesized
QGQSGQGACRICQDHPATKWNSGGGSSGGSISSGLLSGRSDIHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1822 - protein, 254 aa, Artificial Sequence
  chemically synthesized
ACRICQDHPATKWNSGGGSSGGSISSGLLSGRSDQHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1823 - protein, 261 aa, Artificial Sequence
  chemically synthesized
QGQSGQGACRICQDHPATKWNSGGGSSGGSISSGLLSGRSDQHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1824 - protein, 254 aa, Artificial Sequence
  chemically synthesized
ACRICQDHPATKWNSGGGSSGGSISSGLLSGRSDTHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1825 - protein, 261 aa, Artificial Sequence
  chemically synthesized
QGQSGQGACRICQDHPATKWNSGGGSSGGSISSGLLSGRSDTHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1826 - protein, 254 aa, Artificial Sequence
  chemically synthesized
ACRICQDHPATKWNSGGGSSGGSISSGLLSGRSDYHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1827 - protein, 261 aa, Artificial Sequence
  chemically synthesized
QGQSGQGACRICQDHPATKWNSGGGSSGGSISSGLLSGRSDYHGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1828 - protein, 254 aa, Artificial Sequence
  chemically synthesized
ACRICQDHPATKWNSGGGSSGGSISSGLLSGRSANIGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1829 - protein, 261 aa, Artificial Sequence
  chemically synthesized
QGQSGQGACRICQDHPATKWNSGGGSSGGSISSGLLSGRSANIGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1830 - protein, 254 aa, Artificial Sequence
  chemically synthesized
ACRICQDHPATKWNSGGGSSGGSISSGLLSGRSDNIGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1831 - protein, 261 aa, Artificial Sequence
  chemically synthesized
QGQSGQGACRICQDHPATKWNSGGGSSGGSISSGLLSGRSDNIGGGSYELTQPPSASVNVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPKSSPKVTVFPPSPEELRTNKATLVCLVNDFYPGSATVTWKANGATINDGVKTTKPSKQGQNYMTSSYLSLTADQWKSHNRVSCQVTHEGETVEKSLSPAECL

SEQ ID NO: 1832 - protein, 17 aa, Artificial Sequence
  chemically synthesized
VISTHYGDTVYNQRFKG

SEQ ID NO: 1833 - protein, 16 aa, Artificial Sequence
  chemically synthesized
KSSQSLLDSGNQKNFL

SEQ ID NO: 1834 - protein, 220 aa, Artificial Sequence
  chemically synthesized
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1835 - protein, 115 aa, Artificial Sequence
  chemically synthesized
DVQLQESGPGLVKPSQSLSLTCTVTGHSITSDYAWNWIRQFPGNKLEWMGYISYSGRTSYNPSLTSRISITRDTSKNQFFLQLNSVTTEDTATYYCARGYALDYWGQGTSVTVSS

SEQ ID NO: 1836 - protein, 120 aa, Artificial Sequence
  chemically synthesized
EVKLVESGGGLVSPGGSLKLSCAASGFTFSTFGMSWVRQTPEKRLEWVATISGGGSDTYYPDSVQGRFIISRYNAKNNLYLQMNSLRPEDTALYYCARQGYDVYSWFAYWGQGTLVTVSA

SEQ ID NO: 1837 - protein, 118 aa, Artificial Sequence
  chemically synthesized
EVKLVESGGGLVKPGGSLKLSCAASGFTFSTYGMSWVRQTPEKRLQWVATISGGGSNTYYSDSVKGRFTISRDNAKNNLYLQMSSLRSEDTALYYCARQRDSAWFASWGQGTLVTVSA

SEQ ID NO: 1838 - protein, 120 aa, Artificial Sequence
  chemically synthesized
EVQLVESGGGLVKPGGSLRLSCAASGFTFSTFGMSWVRQAPGKGLEWVSTISGGGSDTYYPDSVQGRFTISRDNAKNSLYLQMNSLRAEDTAVYYCARQGYDVYSWFAYWGQGTLVTVSS

SEQ ID NO: 1839 - protein, 120 aa, Artificial Sequence
  chemically synthesized
EVQLVESGGGLVQPGGSLRLSCAASGFTFSTFGMSWVRQAPGKGLEWVATISGGGSDTYYPDSVQGRFTISRDNAKNSLYLQMNSLRAEDTAVYYCARQGYDVYSWFAYWGQGTLVTVSS

SEQ ID NO: 1840 - protein, 118 aa, Artificial Sequence
  chemically synthesized
EVQLVESGGGLVKPGGSLRLSCAASGFTFSTYGMSWVRQAPGKGLEWVATISGGGSNTYYSDSVKGRFTISRDDSKNTLYLQMNSLKTEDTAVYYCARQRDSAWFASWGQGTLVTVSS

SEQ ID NO: 1841 - protein, 119 aa, Artificial Sequence
  chemically synthesized
EVQLVQSGAEVKKPGASVKVSCKASGYRFPHYGISWVRQAPGQGLEWMGWISAYNGNTNYAQKLQGRVTMTTDTSTNTAYMELRSLRSDDTAVYYCARDVDYGTGSGYWGQGTLVTVSS

SEQ ID NO: 1842 - protein, 119 aa, Artificial Sequence
  chemically synthesized
EVQLVQSGAEVKKPGASVKVSCKASGYRFTRQGISWVRQAPGQGLEWMGWISAYNGNTKYAQKLQGRVTMTTDTSTNTAYMELRSLRSDDTAVYYCARDVDYGSGSGYWGQGTLVTVSS

SEQ ID NO: 1843 - protein, 119 aa, Artificial Sequence
  chemically synthesized
EVQLVQSGAEVKKPGASVKVSCKASGYRFSTFGISWVRQAPGQGLEWMGWISAYNGNTNYAQKLQGRVTMTTDTSTNTAYMELRSLRSDDTAVYYCARDVDYSSGSGYWGQGTLVTVSS

SEQ ID NO: 1844 - protein, 119 aa, Artificial Sequence
  chemically synthesized
EVQLVQSGAEVKKPGASVKVSCKASGYRFTRYGISWVRQAPGQGLEWMGWVSAHNGNTNYAQKLQGRVTMTTDTSTNTAYMELRSLRSDDTAVYYCARDADYGSGSGYWGQGTLVTVSS

SEQ ID NO: 1845 - protein, 119 aa, Artificial Sequence
  chemically synthesized
EVQLVQSGAEVKKPGASVKVSCKASGYRFPHYGISWVRQAPGQGLEWMGWISAYNGNTNYAQKLQGRVTMTTDTSTNTAYMELRSLRSDDTAVYYCARDAEYGSGSGYWGQGTLVTVSS

SEQ ID NO: 1846 - protein, 119 aa, Artificial Sequence
  chemically synthesized
EVQLVQSGAEVKKPGASVKVSCKASGYRFTWYGISWVRQAPGQGLEWMGWISAYNGNTNYAQKLQGRVTMTTDTSTNTAYMELRSLRSDDTAVYYCARDSEYSSGSGYWGQGTLVTVSS

SEQ ID NO: 1847 - protein, 119 aa, Artificial Sequence
  chemically synthesized
EVQLVQSGAEVKKPGASVKVSCKASGYRFETYGISWVRQAPGQGLEWMGWISAYNGNTNYAQKLQGRVTMTTDTSTNTAYMELRSLRSDDTAVYYCARDAEYSLGSGYWGQGTLVTVSS

SEQ ID NO: 1848 - protein, 119 aa, Artificial Sequence
  chemically synthesized
EVQLVQSGAEVKKPGASVKVSCKASGYRFRQYGISWVRQAPGQGLEWMGWISAYNGNTNYAQKLQGRVTMTTDTSTNTAYMELRSLRSDDTAVYYCARDAEYGSGSGYWGQGTLVTVSS

SEQ ID NO: 1849 - protein, 119 aa, Artificial Sequence
  chemically synthesized
EVQLVQSGAEVKKPGASVKVSCKASGYRFTWYGISWVRQAPGQGLEWMGWISAYNGNTNYAQKLQGRVTMTTDTSTNTAYMELRSLRSDDTAVYYCARDSEYRSGSGYWGQGTLVTVSS

SEQ ID NO: 1850 - protein, 119 aa, Artificial Sequence
  chemically synthesized
EVQLVQSGAEVKKPGASVKVSCKASGYRFRQYGISWVRQAPGQGLEWMGWISAYNGNTNYAQKLQGRVTMTTDTSTNTAYMELRSLRSDDTAVYYCARDAEYRSGSGYWGQGTLVTVSS

SEQ ID NO: 1851 - protein, 120 aa, Artificial Sequence
  chemically synthesized
EVQLVQSGAEVKKPGASVKVSCKASGYRFTRYGISWVRQAPGQGLEWMGWVSAHNGNTNYAQKLQGRVTMTTDTSTNTAYMELRSLRSDDTAVYYCARDADYRSGSGYWGQGTLVTVSSS

SEQ ID NO: 1852 - protein, 119 aa, Artificial Sequence
  chemically synthesized
EVQLVQSGAEVKKPGASVKVSCKASGYRFPHYGISWVRQAPGQGLEWMGWISAYNGNTNYAQKLQGRVTMTTDTSTNTAYMELRSLRSDDTAVYYCARDVDYRTGSGYWGQGTLVTVSS

SEQ ID NO: 1853 - protein, 119 aa, Artificial Sequence
  chemically synthesized
EVQLVQSGAEVKKPGASVKVSCKASGYRFSTFGISWVRQAPGQGLEWMGWISAYNGNTNYAQKLQGRVTMTTDTSTNTAYMELRSLRSDDTAVYYCARDVDYRSGSGYWGQGTLVTVSS

SEQ ID NO: 1854 - protein, 119 aa, Artificial Sequence
  chemically synthesized
EVQLVQSGAEVKKPGASVKVSCKASGYRFTRQGISWVRQAPGQGLEWMGWISAYNGNTKYAQKLQGRVTMTTDTSTNTAYMELRSLRSDDTAVYYCARDVDYRSGSGYWGQGTLVTVSS

SEQ ID NO: 1855 - protein, 119 aa, Artificial Sequence
  chemically synthesized
EVQLVQSGAEVKKPGASVKVSCKASGYRFPHYGISWVRQAPGQGLEWMGWISAYNGNTNYAQKLQGRVTMTTDTSTNTAYMELRSLRSDDTAVYYCARDAEYRSGSGYWGQGTLVTVSS

SEQ ID NO: 1856 - protein, 108 aa, Artificial Sequence
  chemically synthesized
NIVMTQTPKFLLVSAGDRITITCKASQSVSDDVAWYQQKPGQSPKLLISYAFKRYIGVPDRFTGSGYGTDFTFTISTVQAEDLAVYFCQQNYNSPYTFGGGTKLELKR

SEQ ID NO: 1857 - protein, 106 aa, Artificial Sequence
  chemically synthesized
QIVLSQSPAILSASPGEKVTMTCRTSSSVNYMHWFQQKPGSSPKPWIYATSKLASGVPARFSGSGSGTSYSLTISRVEAEDAATYFCQQWISDPWTFGGGTKLEIK

SEQ ID NO: 1858 - protein, 108 aa, Artificial Sequence
  chemically synthesized
SYELTQPPSVSVSPGQTARITCSGDALTTQYAYWYQQKPGQAPVMVIYKDTERPSGIPERFSGSSSGTKVTLTISGVQAEDEADYYCQSADNSITYRVFGGGTKVTVL

SEQ ID NO: 1859 - protein, 108 aa, Artificial Sequence
  chemically synthesized
SYELTQPPSVSVSPGQTARITCSGDALSEQYAYWYQQKPGQAPVMVIYKDTERPSGIPERFSGSSSGTKVTLTISGVQAEDEADYYCQSADNSITYRVFGGGTKVTVL

SEQ ID NO: 1860 - protein, 106 aa, Artificial Sequence
  chemically synthesized
SYELTQPPSVSVSPGQTARITCSGDALPKQYAYWYQQKPGQAPVMVLYKDTERPSGIPERFSGSSSGTKVTLTISGVQAEDEDYYCQSDNSITYRVFGGGTKVTVL

SEQ ID NO: 1861 - protein, 108 aa, Artificial Sequence
  chemically synthesized
SYELTQPPSVSVSPGQTARITCSGDALPMQYGYWYQQKPGQAPVMVIYKDTERPSGIPERFSGSSSGTKVTLTISGVQAEDEADYYCQSADNSITYRVFGGGTKVTVL

SEQ ID NO: 1862 - protein, 111 aa, Artificial Sequence
  chemically synthesized
DIILTQSPASLAVSLGQRAAISCRASESVDNSGISFMSWFQQKPGQPPKLLIYTASNQGSGVPARFSGSGSGTEFSLNIHPMEEDDTAMYFCQQSKEVPWTFGGGTKLEIR

SEQ ID NO: 1863 - protein, 111 aa, Artificial Sequence
  chemically synthesized
DIVLTQSPASLAVSLGQRATISCRASENVDDYGVSFMNWFQQKPGQPPKLLIYPASNQGSGVPARFSGSGSGTDFSLNIHPMEEDDTAMYFCQQSKEVPWTFGGGTKLEIK

SEQ ID NO: 1864 - protein, 111 aa, Artificial Sequence
  chemically synthesized
DIQLTQSPSFLSASVGDRVTITCRASESVDNSGISFMSWYQQKPGKAPKLLIYTASNQGSGVPSRFSGSGSGTEFTLTISSLQPEDFATYYCQQSKEVPWTFGQGTKVEIK

SEQ ID NO: 1865 - protein, 111 aa, Artificial Sequence
  chemically synthesized
EIVLTQSPATLSLSPGERATLSCRASESVDNSGISFMSWYQQKPGQAPRLLIYTASNQGSGIPARFSGSGSGTDFTLTISSLEPEDFAVYYCQQSKEVPWTFGQGTKVEIK

SEQ ID NO: 1866 - protein, 111 aa, Artificial Sequence
  chemically synthesized
EIVLTQSPATLSLSPGERATLSCRASENVDDYGVSFMNWYQQKPGQAPRLLIYPASNQGSGIPARFSGSGSGTDFTLTISSLEPEDFAVYYCQQSKEVPWTFGQGTKVEIK

SEQ ID NO: 1867 - protein, 111 aa, Artificial Sequence
  chemically synthesized
EIVLTQSPGTLSLSPGERATLSCRASENVDDYGVSFMNWYQQKPGQAPRLLIYPASNQGSGIPDRFSGSGSGTDFTLTISRLEPEDFAVYYCQQSKEVPWTFGQGTKVEIK

SEQ ID NO: 1868 - protein, 111 aa, Artificial Sequence
  chemically synthesized
DIVMTQSPDSLAVSLGERATINCRASENVDDYGVSFMNWYQQKPGQPPKLLIYPASNQGSGVPDRFSGSGSGTDFTLTISSLQAEDVAVYYCQQSKEVPWTFGGGTKLEIK

SEQ ID NO: 1869 - protein, 119 aa, Artificial Sequence
  chemically synthesized
EVQLVQSGAEVKKPGASVKVSCKASGYRFETYGISWVRQAPGQGLEWMGWISAYNGNTNYAQKLQGRVTMTTDTSTNTAYMELRSLRSDDTAVYYCARDAEYRLGSGYWGQGTLVTVSS

SEQ ID NO: 1870 - protein, 117 aa, Artificial Sequence
  chemically synthesized
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLLTGTFAYWGQGTLVTVSS

SEQ ID NO: 1871 - protein, 117 aa, Artificial Sequence
  chemically synthesized
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 1872 - protein, 117 aa, Artificial Sequence
  chemically synthesized
QVQLVQSGAEVKKPGASVKVSCKASGYTFTSYWINWVRQAPGQGLEWMGNIYPGSSITNYNEKFKNRVTMTRDTSTSTVYMELSSLRSEDTAVYYCARLTTGTFAYWGQGTLVTVSS

SEQ ID NO: 1873 - protein, 117 aa, Artificial Sequence
  chemically synthesized
QVQLVQSGAEVKKPGASVKVSCKASGYTFTSYWINWVRQAPGQGLEWMGNIWPGSSLTNYNEKFKNRVTMTRDTSTSTVYMELSSLRSEDTAVYYCARLLTGTFAYWGQGTLVTVSS

SEQ ID NO: 1874 - protein, 113 aa, Artificial Sequence
  chemically synthesized
DIVMTQSPDSLAVSLGERATINCKSSQSLWDSGNQKNFLTWYQQKPGQPPKLLIYWTSTRESGVPDRFSGSGSGTDFTLTISSLQAEDVAVYYCQNDYFYPLTFGGGTKVEIK

SEQ ID NO: 1875 - protein, 113 aa, Artificial Sequence
  chemically synthesized
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPLTFGGGTKVEIK

SEQ ID NO: 1876 - protein, 113 aa, Artificial Sequence
  chemically synthesized
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 1877 - protein, 113 aa, Artificial Sequence
  chemically synthesized
DIVMTQSPDSLAVSLGERATINCKSSQSLWDSTNQKNFLTWYQQKPGQPPKLLIYWTSTRESGVPDRFSGSGSGTDFTLTISSLQAEDVAVYYCQNDYFYPLTFGGGTKVEIK

SEQ ID NO: 1878 - protein, 444 aa, Artificial Sequence
  chemically synthesized
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1879 - protein, 443 aa, Artificial Sequence
  chemically synthesized
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 1880 - protein, 221 aa, Artificial Sequence
  chemically synthesized
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIKRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1881 - protein, 6 aa, Artificial Sequence
  chemically synthesized
  MISC_FEATURE (2)..(2): Xaa is Thr, Arg or Ile
  MISC_FEATURE (3)..(3): Xaa is Phe or Leu
  MISC_FEATURE (4)..(4): Xaa is Ser, Glu, Thr, Pro or Arg
  MISC_FEATURE (5)..(5): Xaa is Thr, Ser, His, Gln, Arg or Trp
  MISC_FEATURE (6)..(6): Xaa is Phe, Tyr or Gln
GXXXXX

SEQ ID NO: 1882 - protein, 17 aa, Artificial Sequence
  chemically synthesized
  MISC_FEATURE (2)..(2): Xaa is Ile or Val
  MISC_FEATURE (5)..(5): Xaa is Tyr or His
  MISC_FEATURE (10)..(10): Xaa is Lys or Asn
WXSAXNGNTXYAQKLQG

SEQ ID NO: 1883 - protein, 10 aa, Artificial Sequence
  chemically synthesized
  MISC_FEATURE (1)..(1): Xaa is Gln or Absent
  MISC_FEATURE (4)..(4): Xaa is Gly or Asp
  MISC_FEATURE (5)..(5): Xaa is Asn or Val
  MISC_FEATURE (7)..(7): Xaa is Leu or Ser
  MISC_FEATURE (8)..(8): Xaa is Tyr or Trp
  MISC_FEATURE (9)..(9): Xaa is Asp or Ala
  MISC_FEATURE (10)..(10): Xaa is Tyr or Val
XGYXXYXXXX

SEQ ID NO: 1884 - protein, 11 aa, Artificial Sequence
  chemically synthesized
  MISC_FEATURE (6)..(6): Xaa is Pro, Thr or Ser
  MISC_FEATURE (7)..(7): Xaa is Met, Thr, Glu or Lys
  MISC_FEATURE (10)..(10): Xaa is Gly or Ala
SGDALXXQYXY

SEQ ID NO: 1885 - protein, 9 aa, Artificial Sequence
  chemically synthesized
  MISC_FEATURE (3)..(3): Xaa is Asn, Ser or Trp
  MISC_FEATURE (4)..(4): Xaa is Tyr, Lys or Ile
  MISC_FEATURE (5)..(5): Xaa is Asn, Glu or Ser
  MISC_FEATURE (6)..(6): Xaa is Ser, Val, Asp or Thr
  MISC_FEATURE (8)..(8): Xaa is Tyr or Trp
QQXXXXPXT

SEQ ID NO: 1886 - protein, 4 aa, Artificial Sequence
  chemically synthesized
  MISC_FEATURE (1)..(1): Xaa is Thr, Arg, Trp, Gln, His or Ser
  MISC_FEATURE (2)..(2): Xaa is Tyr, Phe or Gln
  MISC_FEATURE (4)..(4): Xaa is Met or Ile
XXGX

SEQ ID NO: 1887 - protein, 17 aa, Artificial Sequence
  chemically synthesized
  MISC_FEATURE (1)..(1): Xaa is Thr or Ala
  MISC_FEATURE (5)..(5): Xaa is Ser or Gly
  MISC_FEATURE (7)..(7): Xaa is Ser or Gly
  MISC_FEATURE (8)..(8): Xaa is Ser, Asp or Asn
  MISC_FEATURE (12)..(12): Xaa is Ala, Pro or Ser
  MISC_FEATURE (16)..(16): Xaa is Lys or Gln
XISGXGXXTYYXDSVXG

SEQ ID NO: 1888 - protein, 6 aa, Artificial Sequence
  chemically synthesized
  MISC_FEATURE (2)..(2): Xaa is Ala, Val or Ser
  MISC_FEATURE (3)..(3): Xaa is Asp or Glu
  MISC_FEATURE (5)..(5): Xaa is Ser, Gly or Arg
  MISC_FEATURE (6)..(6): Xaa is Ser, Leu or Thr
DXXYXX

SEQ ID NO: 1889 - protein, 7 aa, Artificial Sequence
  chemically synthesized
GYIFSSY

SEQ ID NO: 1890 - protein, 6 aa, Artificial Sequence
  chemically synthesized
FPGSGS

SEQ ID NO: 1891 - protein, 10 aa, Artificial Sequence
  chemically synthesized
GYGNYLYFDV

SEQ ID NO: 1892 - protein, 7 aa, Artificial Sequence
  chemically synthesized
YAFKRYI

SEQ ID NO: 1893 - protein, 9 aa, Artificial Sequence
  chemically synthesized
QQNYNSPYT

SEQ ID NO: 1894 - protein, 5 aa, Artificial Sequence
  chemically synthesized
SYWIG

SEQ ID NO: 1895 - protein, 17 aa, Artificial Sequence
  chemically synthesized
KIFPGSGSADYNENFKG

SEQ ID NO: 1896 - protein, 10 aa, Artificial Sequence
  chemically synthesized
DSEYSSGSGY

SEQ ID NO: 1897 - protein, 11 aa, Artificial Sequence
  chemically synthesized
SGDALTTQYAY

SEQ ID NO: 1898 - protein, 15 aa, Artificial Sequence
  chemically synthesized
RASESVDNSGISFMS

SEQ ID NO: 1899 - protein, 7 aa, Artificial Sequence
  chemically synthesized
ATSKLAS

SEQ ID NO: 1900 - protein, 9 aa, Artificial Sequence
  chemically synthesized
QQWISDPWT

SEQ ID NO: 1901 - protein, 11 aa, Artificial Sequence
  chemically synthesized
SGDALSEQYAY

SEQ ID NO: 1902 - protein, 7 aa, Artificial Sequence
  chemically synthesized
TASNQGS

SEQ ID NO: 1903 - protein, 11 aa, Artificial Sequence
  chemically synthesized
SGDALPMQYGY

SEQ ID NO: 1904 - protein, 10 aa, Artificial Sequence
  chemically synthesized
RTSSSVNYMH

SEQ ID NO: 1905 - protein, 7 aa, Artificial Sequence
  chemically synthesized
GYRFTWY

SEQ ID NO: 1906 - protein, 6 aa, Artificial Sequence
  chemically synthesized
SAYNGN

SEQ ID NO: 1907 - protein, 10 aa, Artificial Sequence
  chemically synthesized
DVDYSSGSGY

SEQ ID NO: 1908 - protein, 5 aa, Artificial Sequence
  chemically synthesized
WYGIS

SEQ ID NO: 1909 - protein, 10 aa, Artificial Sequence
  chemically synthesized
DAEYSLGSGY

SEQ ID NO: 1910 - protein, 7 aa, Artificial Sequence
  chemically synthesized
GYRFSTF

SEQ ID NO: 1911 - protein, 6 aa, Artificial Sequence
  chemically synthesized
SAHNGN

SEQ ID NO: 1912 - protein, 10 aa, Artificial Sequence
  chemically synthesized
DAEYGSGSGY

SEQ ID NO: 1913 - protein, 5 aa, Artificial Sequence
  chemically synthesized
TFGIS

SEQ ID NO: 1914 - protein, 17 aa, Artificial Sequence
  chemically synthesized
WVSAHNGNTNYAQKLQG

SEQ ID NO: 1915 - protein, 10 aa, Artificial Sequence
  chemically synthesized
DADYGSGSGY

SEQ ID NO: 1916 - protein, 7 aa, Artificial Sequence
  chemically synthesized
GYRFETY

SEQ ID NO: 1917 - protein, 5 aa, Artificial Sequence
  chemically synthesized
SYSGR

SEQ ID NO: 1918 - protein, 10 aa, Artificial Sequence
  chemically synthesized
DVDYGTGSGY

SEQ ID NO: 1919 - protein, 7 aa, Artificial Sequence
  chemically synthesized
GYRFRQY

SEQ ID NO: 1920 - protein, 16 aa, Artificial Sequence
  chemically synthesized
YISYSGRTSYNPSLTS

SEQ ID NO: 1921 - protein, 10 aa, Artificial Sequence
  chemically synthesized
DVDYGSGSGY

SEQ ID NO: 1922 - protein, 5 aa, Artificial Sequence
  chemically synthesized
QYGIS

SEQ ID NO: 1923 - protein, 6 aa, Artificial Sequence
  chemically synthesized
SGGGSD

SEQ ID NO: 1924 - protein, 7 aa, Artificial Sequence
  chemically synthesized
GYRFTRY

SEQ ID NO: 1925 - protein, 17 aa, Artificial Sequence
  chemically synthesized
TISGGGSDTYYPDSVQG

SEQ ID NO: 1926 - protein, 5 aa, Artificial Sequence
  chemically synthesized
RYGIS

SEQ ID NO: 1927 - protein, 11 aa, Artificial Sequence
  chemically synthesized
QGYDVYSWFAY

SEQ ID NO: 1928 - protein, 7 aa, Artificial Sequence
  chemically synthesized
GYRFPHY

SEQ ID NO: 1929 - protein, 5 aa, Artificial Sequence
  chemically synthesized
HYGIS

SEQ ID NO: 1930 - protein, 7 aa, Artificial Sequence
  chemically synthesized
GYRFTRQ

SEQ ID NO: 1931 - protein, 5 aa, Artificial Sequence
  chemically synthesized
RQGIS

SEQ ID NO: 1932 - protein, 8 aa, Artificial Sequence
  chemically synthesized
GHSITSDY

SEQ ID NO: 1933 - protein, 7 aa, Artificial Sequence
  chemically synthesized
GFTFSTF

SEQ ID NO: 1934 - protein, 5 aa, Artificial Sequence
  chemically synthesized
TFGMS

SEQ ID NO: 1935 - protein, 8 aa, Artificial Sequence
  chemically synthesized
GWSLTGPG

SEQ ID NO: 1936 - protein, 7 aa, Artificial Sequence
  chemically synthesized
IYGDGST

SEQ ID NO: 1937 - protein, 8 aa, Artificial Sequence
  chemically synthesized
AYEYAMDW

SEQ ID NO: 1938 - protein, 10 aa, Artificial Sequence
  chemically synthesized
WSVSTSGKSY

SEQ ID NO: 1939 - protein, 3 aa, Artificial Sequence
  chemically synthesized
LLS

SEQ ID NO: 1940 - protein, 10 aa, Artificial Sequence
  chemically synthesized
GYTFTSYWIN

SEQ ID NO: 1941 - protein, 6 aa, Artificial Sequence
  chemically synthesized
YPGSSL

SEQ ID NO: 1942 - protein, 8 aa, Artificial Sequence
  chemically synthesized
LSTGTFAY

SEQ ID NO: 1943 - protein, 17 aa, Artificial Sequence
  chemically synthesized
KSSQSLWDSTNQKNFLT

SEQ ID NO: 1944 - protein, 7 aa, Artificial Sequence
  chemically synthesized
WTSTRES

SEQ ID NO: 1945 - protein, 9 aa, Artificial Sequence
  chemically synthesized
QNDYFYPLT

SEQ ID NO: 1946 - protein, 7 aa, Artificial Sequence
  chemically synthesized
GYTFTSY

SEQ ID NO: 1947 - protein, 17 aa, Artificial Sequence
  chemically synthesized
NIYPGSSLTNYNEKFKN

SEQ ID NO: 1948 - protein, 8 aa, Artificial Sequence
  chemically synthesized
LTTGTFAY

SEQ ID NO: 1949 - protein, 17 aa, Artificial Sequence
  chemically synthesized
KSSQSLWDSGNQKNFLT

SEQ ID NO: 1950 - protein, 7 aa, Artificial Sequence
  chemically synthesized
WTSYRES

SEQ ID NO: 1951 - protein, 9 aa, Artificial Sequence
  chemically synthesized
QNDYFYPHT

SEQ ID NO: 1952 - protein, 5 aa, Artificial Sequence
  chemically synthesized
SYWIN

SEQ ID NO: 1953 - protein, 6 aa, Artificial Sequence
  chemically synthesized
YPGSSI

SEQ ID NO: 1954 - protein, 8 aa, Artificial Sequence
  chemically synthesized
LLTGTFAY

SEQ ID NO: 1955 - protein, 17 aa, Artificial Sequence
  chemically synthesized
KSSQSLLDSGNQKNFLT

SEQ ID NO: 1956 - protein, 7 aa, Artificial Sequence
  chemically synthesized
  MISC_FEATURE (4)..(4): Xaa is Thr or Tyr
WTSXRES

SEQ ID NO: 1957 - protein, 9 aa, Artificial Sequence
  chemically synthesized
QNDYSYPLT

SEQ ID NO: 1958 - protein, 17 aa, Artificial Sequence
  chemically synthesized
NIYPGSSITNYNEKFKN

SEQ ID NO: 1959 - protein, 8 aa, Artificial Sequence
  chemically synthesized
  MISC_FEATURE (2)..(2): Xaa is Leu or Ser
LXTGTFAY

SEQ ID NO: 1960 - protein, 17 aa, Artificial Sequence
  chemically synthesized
  MISC_FEATURE (7)..(7): Xaa is Trp or Leu
  MISC_FEATURE (10)..(10): Xaa is Gly or Thr
KSSQSLXDSXNQKNFLT

SEQ ID NO: 1961 - protein, 9 aa, Artificial Sequence
  chemically synthesized
  MISC_FEATURE (5)..(5): Xaa is Phe or Ser
  MISC_FEATURE (8)..(8): Xaa is Leu or His
QNDYXYPXT

SEQ ID NO: 1962 - protein, 6 aa, Artificial Sequence
  chemically synthesized
WPGSSL

SEQ ID NO: 1963 - protein, 17 aa, Artificial Sequence
  chemically synthesized
NIWPGSSLTNYNEKFKN

SEQ ID NO: 1964 - protein, 17 aa, Artificial Sequence
  chemically synthesized
NIYPGSSSTNYNEKFKN

SEQ ID NO: 1965 - protein, 17 aa, Artificial Sequence
  chemically synthesized
  MISC_FEATURE (3)..(3): Xaa is Tyr or Trp
  MISC_FEATURE (8)..(8): Xaa is Leu, Ile or Ser
NIXPGSSXTNYNEKFKN

SEQ ID NO: 1966 - protein, 8 aa, Artificial Sequence
  chemically synthesized
GLTFSSSG

SEQ ID NO: 1967 - protein, 6 aa, Artificial Sequence
  chemically synthesized
ATNNDY

SEQ ID NO: 1968 - protein, 7 aa, Artificial Sequence
  chemically synthesized
TASNRAT

SEQ ID NO: 1969 - protein, 9 aa, Artificial Sequence
  chemically synthesized
QQYSNWPRT

SEQ ID NO: 1970 - protein, 19 aa, Artificial Sequence
  chemically synthesized
GLSGRSDNHGGAVGLLAPP

SEQ ID NO: 1971 - protein, 21 aa, Artificial Sequence
  chemically synthesized
GLSGRSDNHGGVHMPLGFLGP

SEQ ID NO: 1972 - protein, 120 aa, Artificial Sequence
  chemically synthesized
EVQLQESGPELVRPGASVKMSCKASGYTFTSYWMHWVKQRPGQGLEWIGMIDPSNSETSLNQKFKDKATLNVDKSTNTAYMQLSSLTSEDSAVYYCARSRGNYAYEMDYWGQGTSVTVSS

SEQ ID NO: 1973 - protein, 120 aa, Artificial Sequence
  chemically synthesized
EVQLQESGPELVRPGASVKMSCKASGYTFTSYWMHWVKQRPGQGLEWIGMIEPSSSETSLNQKFKDKATLNVDKSSNTAYMQLSSLTSEDSAVYYCARSRGNYAYEMDYWGQGTSVTVSS

SEQ ID NO: 1974 - protein, 120 aa, Artificial Sequence
  chemically synthesized
EVQLQESGPELVRPGASVKMSCKASGYTFTSYWMHWVKQRPGQGLEWIGMIDPYSSETSLNQKFKDKATLNVDKISNTAYMQLSSLTSEDSAVYFCARSRGNYAYDMDYWGQGTSVTVSS

SEQ ID NO: 1975 - protein, 120 aa, Artificial Sequence
  chemically synthesized
EVQLQESGPELVRPGASVKMSCKASGYTFTSYWMHWVKQRPGQGLEWIGMIDPSNSETSLNQKFKDKATLNVDKSSKTAYMQLSSLTSEDSAVYYCARSRGNYAYDMDYWGQGTSVTVSS

SEQ ID NO: 1976 - protein, 117 aa, Artificial Sequence
  chemically synthesized
EVQLQESGAELVMPGASVKMSCKASGYTFTDYWMHWVKQRPGQGLEWIGAIDTSDSYTSYHQNFKGKATLTEDESSSTAYMQLSSLTSEDSAIYYCARRDYGGFGYWGQGTTLTVSS

SEQ ID NO: 1977 - protein, 116 aa, Artificial Sequence
  chemically synthesized
EVQLQESGPELVKPGASVKIPCKASGYTFTDYNMDWVKKSHGKSLEWIGDIDPNNGGTIYNQKFKGKATLTVDKSSRTAYMELRSLTSEDTAVYYCARWRSSMDYWGQGTSVTVSS

SEQ ID NO: 1978 - protein, 116 aa, Artificial Sequence
  chemically synthesized
EVQLQESGPELVKPGASVKIPCRASGYIFTDYNMDWVKQSHGKSLEWIGDIDPNNGGTIYNQKFKDKTTLTVDKSSRTAYMELRSLTSEDTAVYYCARWRSSMDYWGQGTSVTVSS

SEQ ID NO: 1979 - protein, 116 aa, Artificial Sequence
  chemically synthesized
EVQLQESGPELVKPGASVKIPCKASGYTFTDYNMDWVKQNHGKSLEWIGDIDPNNGDTIYNQKFKGKATLTVDKSSRTAYMELRSLTSEDTAVYYCARWRSSMDYWGQGTSVTVSS

SEQ ID NO: 1980 - protein, 116 aa, Artificial Sequence
  chemically synthesized
EVQLQESGPELVKPGASVKIPCKASGYTFTDYNMDWVKQSHGKSLEWIGDIDPNSGGSIYNQKFKGKATLTVDKSSRTVYMELRSLTSEDTAVYYCARWRSSMDYWGQGTSVTVSS

SEQ ID NO: 1981 - protein, 116 aa, Artificial Sequence
  chemically synthesized
EVQLQESGPELVKPGASVKITCKASGYTFTDYNMDWVKQSHGKSLEWIGDIDPNNGGTIYNQKFKGKATLTVDKSSNTAYMELRSLASEDTAVYYCARWRSSMDYWGQGTSVSVSS

SEQ ID NO: 1982 - protein, 116 aa, Artificial Sequence
  chemically synthesized
EVQLQESGPELVKPGASVKIPCKASGYTFTDYNMDWVKQSHGKSLEWIGDIDPNNGGTIYNQNFKGKATLTVDKSSSTAYMELRSLTSEDTAVYYCARWRSSMDYWGQGTSVTVSS

SEQ ID NO: 1983 - protein, 116 aa, Artificial Sequence
  chemically synthesized
EVQLQESGPELVKPGASVKIPCKASGYTFTDYNMDWVKQSHGKSLEWIGDIDPNNGGIIYNQKFKGKAALTVDKSSSTAYMELRSLTSEDTAVYYCARWRSSMDYWGQGTSVTVSS

SEQ ID NO: 1984 - protein, 116 aa, Artificial Sequence
  chemically synthesized
EVQLQESGPELVKPGASVKIPCKASGYTFTDYNMDWVKQSHGKSLEWIGDIDPNNGGIIYNQKFKGKAALTVDKSSSTAYMELRSLTSEDTAVYYCTRWRSSMDYWGQGTSVTVSS

SEQ ID NO: 1985 - protein, 116 aa, Artificial Sequence
  chemically synthesized
EVQLQESGPELVKPGASVKIPCKASGYTFTDYNMDWVKQSHGKSLEWIGDIDPNNGNTIYNQKFKGKATLTVDKSSSTAYMELRSLTSEDTAVYYCTKWRSSMDYWGQGTSVTVSS

SEQ ID NO: 1986 - protein, 116 aa, Artificial Sequence
  chemically synthesized
EVQLQESGPELVRPGASVKIPCKASGYTFTDYNMDWVMQSHGKSLEWIGDIDPNNGGTIYNQKFKGKATLTVDKSSSTAYMELRSLTSEDTAVYYCTRWRSSMDYWGQGTSVTVSS

SEQ ID NO: 1987 - protein, 116 aa, Artificial Sequence
  chemically synthesized
EVQLQESGPELVKPGASVKIPCKASGYTFTDYNVDWVKQSHGKSLEWIGDIDPNNGGTFYNQKFKGKATLTVDKSSSTAHMELRSLTSEDTAVYYCVRWRSSMDYWGQGTSVTVSS

SEQ ID NO: 1988 - protein, 116 aa, Artificial Sequence
  chemically synthesized
EVQLQESGPELVKPGASVKIPCKASGYTFTDYNMDWVKQSHGKSLEWIGDIDPNTGTTFYNQDFKGKATLTVDKSSSTAYMELRSLTSEDTAVYYCARWRSSMDYWGQGTSLTVSS

SEQ ID NO: 1989 - protein, 120 aa, Artificial Sequence
  chemically synthesized
EVQLQESGAELVRPGASVTLSCKASGYTFTDYEMHWVKQTPVHGLEWIGVIDPGTGGTAYNQKFKVKALLTADKSSNTAYMELRSLTSEDSAVYYCTSEKFGSNYYFDYWGQGTTLTVSS

SEQ ID NO: 1990 - protein, 120 aa, Artificial Sequence
  chemically synthesized
EVQLQESGAELVRPGASVTLSCKASGYTFTDYEIHWVKQTPVHGLEWIGAIDPETGGTAYNQKFKGKAILTADKSSSTAYMELRSLTSEDSAVYYCTSEKFGSSYYFDYWGQGTTFTVSS

SEQ ID NO: 1991 - protein, 118 aa, Artificial Sequence
  chemically synthesized
EVQLQESGPGLVKPSQSLSLTCTVTGYSITSDYAWNWIRQFPGNKLEWMGYITYSGSPTYNPSLKSQFSITRDTSKNQFFLQLNSLTTEDTATYYCARGLGGHYFDYWGQGTTLTVSS

SEQ ID NO: 1992 - protein, 118 aa, Artificial Sequence
  chemically synthesized
EVQLQESGPGLVKPSQSLSLTCTVTGYSITSDYAWNWIRQFPGNKLEWMGYITYSGSPTYNPSLKSQFSITRDTSKNQFFLQLNSVTTEDTATYYCARGLGGHYFDYWGQGTTLTVSS

SEQ ID NO: 1993 - protein, 117 aa, Artificial Sequence
  chemically synthesized
EVQLQESGPDLVKPSQSLSLTCTVTGYSITSGYSWHWIRQFPGNKLEWMGFIHYSGDTNYNPSLKSRFSITRDTSKNQFFLHLNSVTPEDTATYYCASPSRLLFDYWGHGTTLTVSS

SEQ ID NO: 1994 - protein, 113 aa, Artificial Sequence
  chemically synthesized
EVQLQESGPGLVAPSQSLSITCTVSGFSLTNYGVDWVRQSPGKGLEWLGVIWGVGSTNYNSALKSRLSISKDNSKSQVFLKMNSLQTDDTAMYYCASDGFVYWGQGTLVTVSS

SEQ ID NO: 1995 - protein, 113 aa, Artificial Sequence
  chemically synthesized
EVQLQESGPGLVAPSQSLSITCTVSGFSLTSYGVDWVRQSPGKGLEWLGVIWGIGSTNYNSALKSRLSISKDNSKSQVFLKMNSLQSDDTAMYYCASDGFVYWGQGTLVTVSS

SEQ ID NO: 1996 - protein, 114 aa, Artificial Sequence
  chemically synthesized
EVQLQESGPSLVQPSQSLSITCTVSGFSLTSYGVHWVRQSPGKGLEWLGVIWRGGNTDYNAAFMSRLSITKDNSKSQVFFKMNSLQADDTAIYYCAASMIGGYWGQGTTLTVSS

SEQ ID NO: 1997 - protein, 114 aa, Artificial Sequence
  chemically synthesized
EVQLQESGPSLVQPSQSLSITCTVSGFSLTNYGVHWVRQSPGKGLEWLGVIWRGGNTDYNAAFMSRLSITKDNSKSQVFFKFHSLQTDDTAIYYCAASMIGGYWGQGTTLTVSS

SEQ ID NO: 1998 - protein, 120 aa, Artificial Sequence
  chemically synthesized
QVQLVQSGAEVKKPGASVKVSCKASGYTFTSYWMHWVRQAPGQGLEWMGMIDPSNSETSLNQKFQGRVTMTVDKSTNTVYMELSSLRSEDTAVYYCARSRGNYAYEMDYWGQGTLVTVSS

SEQ ID NO: 1999 - protein, 120 aa, Artificial Sequence
  chemically synthesized
EVQLVQSGAEVKKPGASVKVSCKASGYTFTSYWMHWVRQAPGQGLEWMGMIDPSNSETSLNQKFQGRVTLNVDKSTNTAYMELSSLRSEDTAVYYCARSRGNYAYEMDYWGQGTLVTVSS

SEQ ID NO: 2000 - protein, 120 aa, Artificial Sequence
  chemically synthesized
EVQLVQSGTEVTKPGASVKVSCKASGYTFTSYWMHWVRQAPGQGLEWLGMIDPSNSETTLNQKFQGRVTMTVDKSTNTVYMELTSLRSEDTAVYYCARSRGNYAYEMDYWGQGTLVTVSS

SEQ ID NO: 2001 - protein, 120 aa, Artificial Sequence
  chemically synthesized
EVQLVQSGAEVKKPGASVKVSCKASGYTFTDYEMHWVRQAPGQGLEWMGIIDPGTGGTAYNQKFQGRVTMTADKSTSTVYMELSSLRSEDTAVYYCTSEKFGSNYYFDYWGQGTLVTVSS

SEQ ID NO: 2002 - protein, 120 aa, Artificial Sequence
  chemically synthesized
EVQLVQSGAEVKKPGASVKVSCKASGYTFTDYEMHWVRQAPGQGLEWMGIIDPGTGGTAYNQKFQGRVTMTADKSTNTVYMELSSLRSEDTAVYYCTSEKFGSNYYFDYWGQGTLVTVSS

SEQ ID NO: 2003 - protein, 120 aa, Artificial Sequence
  chemically synthesized
EVQLVQSGAEVKKPGASVKVSCKASGYTFTDYEMHWVRQAPGQRLEWMGVIDPGTGGTAYNQKFQGRVTITADKSASTAYMELSSLRSEDTAVYYCTSEKFGSNYYFDYWGQGTLVTVSS

SEQ ID NO: 2004 - protein, 108 aa, Artificial Sequence
  chemically synthesized
DIVLTQTPAIMSASPGEKVTLTCSASSSVSSNYLYWYQQRPGSSPKLWIYSTSNLASGVPARFSGSGSGTSYSLTISSMEAEDAASYFCHQWSSYPPTFGSGTKLEIK

SEQ ID NO: 2005 - protein, 108 aa, Artificial Sequence
  chemically synthesized
DIVITQTTAIMSASPGEKVTLTCSASSSVSSNYLYWYQQRPGSSPKLWIYSTSNLASGVPARFSGSGSGTSYSLTISSMEAEDAASYFCHQWSSYPPTFGSGTKLEIK

SEQ ID NO: 2006 - protein, 108 aa, Artificial Sequence
  chemically synthesized
DIVMTQTPATMSASPGEKVTLTCSASSSVNSNYLYWYQQKPGSSPKVWIYSTSNLASGVPARFSGSGSGTSYSLTISSMEAEDAASYFCHQWSSYPPTFGSGTKLELK

SEQ ID NO: 2007 - protein, 108 aa, Artificial Sequence
  chemically synthesized
DIVMTQTTATMSASPGEKVTLTCSASSSVNSNYLYWYQQKPGSSPKVWIYSTSNLASGVPARFSGSGSGTSYSLTISSMEAEDAASYFCHQWSSYPPTFGSGTKLELK

SEQ ID NO: 2008 - protein, 108 aa, Artificial Sequence
  chemically synthesized
DIVLTQSTAIMSASPGEKVTLTCSASSGVNSNYLYWYQQKPGSSPKLWIYSTSNLASGVPARFSGSGSGTSYSLTISSVEAEDAASYFCHQWSSYPPTFGSGTKLEIK

SEQ ID NO: 2009 - protein, 107 aa, Artificial Sequence
  chemically synthesized
DIVLTQTPSSLSASLGDRVTISCSASQGISNYLNWYQQKPDGTVKLLIYYTSSLHSGVPSRFSGSGSGTDYSLTISNLEPEDIATYYCQQYSKLPWTFGGGTKLEIK

SEQ ID NO: 2010 - protein, 107 aa, Artificial Sequence
  chemically synthesized
DIVLTQSPSSLSASLGDRVTISCSASQGISNYLNWYQQKPDGTVKLLIYYTSSLHSGVPSRFSGSGSGTDYSLTISNLEPEDIATYYCQQYSKLPWTFGGGTKLEIK

SEQ ID NO: 2011 - protein, 107 aa, Artificial Sequence
  chemically synthesized
DIVITQSPSSLSASLGDRVTISCSASQGISNYLNWYQQKPDGTVKLLIYYTSSLHSGVPSRFSGSGSGTDYSLTISNLEPEDIATYYCQQYSELPWTFGGGTKLEIK

SEQ ID NO: 2012 - protein, 107 aa, Artificial Sequence
  chemically synthesized
DIVMTQSPSSLSASLGDRVTISCSASQGISNYLNWYQQRPDGTVKLLIYYTSSLHSGVPSRFSGSGSGTDYSLTISNLEPEDIATYYCQQYSNLPWTFGGGTKLEIK

SEQ ID NO: 2013 - protein, 107 aa, Artificial Sequence
  chemically synthesized
DIVMTQSPSSLSASLGDRVTISCSASQGISNYLNWYQQKPDGTVKLLIYYTSSLHSGVPSRFSGSGSGTDYSLTISNLEPEDIATYYCQQYSELPWTFGGGTKLEIK

SEQ ID NO: 2014 - protein, 107 aa, Artificial Sequence
  chemically synthesized
DIVMTQSTSSLSASLGDRVTISCSASQGISHYLNWYQQKPDGTVKLLIYYTSSLHSGVPSRFSGSGSGTDYSLTIRNLEPEDIATYYCQQYSELPWTFGGGTKLEIK

SEQ ID NO: 2015 - protein, 107 aa, Artificial Sequence
  chemically synthesized
DIVMTQSPSSLSASLGDRVTISCSASQGISHYLNWYQQKPDGTVKLLIYYTSSLHSGVPSRFSGSGSGTDYSLTIRNLEPEDIATYYCQQYSELPWTFGGGTKLEIK

SEQ ID NO: 2016 - protein, 107 aa, Artificial Sequence
  chemically synthesized
DIVMTQSPSSLSASLGDRVTISCSASQDISSYLNWYQQKPDGTVKLLIYYTSSLHSGVPSRFSGSGSGTDYSLTISNLEPEDIATYYCQQYSELPWTFGGGTKLEIK

SEQ ID NO: 2017 - protein, 107 aa, Artificial Sequence
  chemically synthesized
DIVMTQTPSSLSASLGDRVTISCSASQGISYYLNWYQQKPDGTIKLLIYYTLSLHSGVPSRFSGSGSGTDYSLTISNLEPEDIATYYCQQYSELPWTFGGGTKLEIK

SEQ ID NO: 2018 - protein, 107 aa, Artificial Sequence
  chemically synthesized
DIVMTQTPSSMSASLGDRVTISCSASQGISNYLNWYQQKPDGTVKLLIYYTSSLHSGVPSRFSGSGSGTDYSLTISNLEPEDIATYYCQQYSYLPWTFGGGTKLEIK

SEQ ID NO: 2019 - protein, 107 aa, Artificial Sequence
  chemically synthesized
DIVMTQTPSSLSASLGDRVTISCSASQGIGNYLNWYQQKPDGTVKLLIYYTSNLHSGVPSRFSGRGSGTDYSLTISNLEPEDIATYYCQQYSNLPWTFGGGTKLEIK

SEQ ID NO: 2020 - protein, 107 aa, Artificial Sequence
  chemically synthesized
DIVMTQSPSSLSASLGDRVTISCSASQGISNYLNWYQQKPDGTVKLLIYYTSNLHSGVPSRFSGSGSGTDYSLTISDLAPEDIATYYCQQYSYLPWTFGGGTKLEIK

SEQ ID NO: 2021 - protein, 112 aa, Artificial Sequence
  chemically synthesized
DIVITQSPLSLPVGLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 2022 - protein, 112 aa, Artificial Sequence
  chemically synthesized
DIVLTQTPLSLPVSLGDQASISCRSSQSIVHSNGNTYLEWYLQKPGQSPKLLIYKVSNRFSGVPDRFSGSGSGTNFTLKISRVEAEDLGVYYCFQGSHVPLTFGAGTKLELK

SEQ ID NO: 2023 - protein, 112 aa, Artificial Sequence
  chemically synthesized
DIVLTQSPLSLPVSLGDQASISCRSSQSIVHSDGNTYLEWYLQKPGQSPKLLIYKVSNRFSGVPDRFSGSGSGTDFTLKISRVEAEDLGIYYCFQGSHVPLTFGAGTKLELK

SEQ ID NO: 2024 - protein, 112 aa, Artificial Sequence
  chemically synthesized
DIVITQTPLSLPVSLGDQASISCRSSQTIVHSDGNTYLEWYLQKPGQSPKLLIYKVSNRFSGVPDRFSGSGSGTDFTLKISRVEAEDLGVYYCFQGSHVPLTFGAGTKLEIK

SEQ ID NO: 2025 - protein, 112 aa, Artificial Sequence
  chemically synthesized
DIVMTQSTLSLPVSLGDQVSISCRSSQSIVHSDGNTYLEWYLQKPGQSPNLLIYKVSNRFSGVPDRFSGSGSGTDFTLKISRVEAEDLGVYYCFQGSHVPLTFGAGTKLELK

SEQ ID NO: 2026 - protein, 112 aa, Artificial Sequence
  chemically synthesized
DIVLTQDELSNPVTSGESVSISCRSSKSLLYKDGKTYLNWFLQRPGQSPQVLIYFMSTRASGVSDRFSGSGSGTDFTLEISRVKAEDVGVYYCQQLVDFPFTFGSGTKLELK

SEQ ID NO: 2027 - protein, 112 aa, Artificial Sequence
  chemically synthesized
DIVMTQDELYNPVTSGESVSISCRSSKSLLYKDGKTYLNWFLQRPGQSPQVLIYFMSTRASGVSDRFSGSGSGTDFTLEISRVKAEDVGVYYCQQLVDFPFTFGSGTKLEIK

SEQ ID NO: 2028 - protein, 113 aa, Artificial Sequence
  chemically synthesized
DIVMTQSPSSLTVTAGEKVTMSCKSSQSLLNSGTQKNYLTWYQQKPGQPPKLLIYWASTRESGVPDRFTGSGSGTDFTLTISSVQAEDLAVYYCQNDYSYPLTFGAGTKLEIK

SEQ ID NO: 2029 - protein, 107 aa, Artificial Sequence
  chemically synthesized
DIVLTQTTATLSVTPGDRVSLSCRASQSISDYLHWYQQKSHESPRLLIKYASQSISGIPSRFSGSGSGSDFTLTVNSVEPEDVGVYYCQNGHSYPYTFGGGTKLEIK

SEQ ID NO: 2030 - protein, 107 aa, Artificial Sequence
  chemically synthesized
DIVLTQSPDTLSVTPGDRVSLSCRASQSISDYLHWYQQKSHESPRLLIKYASQSISGIPSRFSGSGSGSDFTLSINSVEPEDVGVYYCQNGHSYPYTFGGGTKLELK

SEQ ID NO: 2031 - protein, 108 aa, Artificial Sequence
  chemically synthesized
EIVLTQSPATLSLSPGERATLSCRASSSVSSNYLYWYQQKPGQAPRLLIYSTSNRATGIPARFSGSGSGTDYTLTISSLEPEDFAVYYCHQWSSYPPTFGQGTKLEIK

SEQ ID NO: 2032 - protein, 108 aa, Artificial Sequence
  chemically synthesized
DIVLTQSPATLSLSPGERATLSCRASSSVSSNYLYWYQQKPGQAPRLLIYSTSNLATGIPARFSGSGSGTDYTLTISSLEPEDFAVYFCHQWSSYPPTFGQGTKLEIK

SEQ ID NO: 2033 - skipped

SEQ ID NO: 2034 - protein, 108 aa, Artificial Sequence
  chemically synthesized
DIVLTQSPGTLSLSPGEKVTLSCRASSSVSSNYLYWYQQKPGQAPRLVIYSTSNLATGIPDRFSGSGSGTDYTLTISRLEPEDFAVYFCHQWSSYPPTFGQGTKVEIK

SEQ ID NO: 2035 - protein, 112 aa, Artificial Sequence
  chemically synthesized
DVVMTQSPLSLPVTLGQPASISCRSSQTIVHSDGNTYLEWYQQRPGQSPRLLIYKVSNRFSGVPDRFSGSGSGTDFTLKISRVEAEDVGVYYCFQGSHVPLTFGQGTKLEIK

SEQ ID NO: 2036 - protein, 112 aa, Artificial Sequence
  chemically synthesized
DIVMTQSPLSLPVTLGQPASISCRSSQTIVHSDGNTYLEWYQQRPGQSPKLLIYKVSNRFSGVPDRFSGSGSGTDFTLKISRVEAEDVGVYYCFQGSHVPLTFGQGTKLEIK

SEQ ID NO: 2037 - protein, 112 aa, Artificial Sequence
  chemically synthesized
DIVMTQTPLSSPVTLGQPASISCRSSQTIVHSDGNTYLEWYQQRPGQPPRLLIYKVSNRFSGVPDRFSGSGAGTDFTLKISRVEAEDVGVYYCFQGSHVPLTFGQGTKLEIK

SEQ ID NO: 2038 - protein, 6 aa, Artificial Sequence
  chemically synthesized
GYALDY

SEQ ID NO: 2039 - protein, 9 aa, Artificial Sequence
  chemically synthesized
QRDSAWFAS

SEQ ID NO: 2040 - protein, 7 aa, Artificial Sequence
  chemically synthesized
YHIRDLT

SEQ ID NO: 2041 - protein, 11 aa, Artificial Sequence
  chemically synthesized
AYISNQGGDTH

SEQ ID NO: 2042 - protein, 6 aa, Artificial Sequence
  chemically synthesized
GQSGQG

SEQ ID NO: 2043 - protein, 5 aa, Artificial Sequence
  chemically synthesized
QSGQG

SEQ ID NO: 2044 - protein, 4 aa, Artificial Sequence
  chemically synthesized
SGQG

SEQ ID NO: 2045 - protein, 3 aa, Artificial Sequence
  chemically synthesized
GQG

SEQ ID NO: 2046 - protein, 2 aa, Artificial Sequence
  chemically synthesized
QG

SEQ ID NO: 2047 - protein, 446 aa, Artificial Sequence
  chemically synthesized
EVQLVESGGGLVQPGGSLRLSCAASGFTFSGYAMSWVRQAPGKGLEWVAYISNSGGNAHYADSVKGRFTISRDNSKNTLYLQMNSLRAEDTAVYYCTREDYGTSPFVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2048 - protein, 448 aa, Artificial Sequence
  chemically synthesized
EVQLVESGGGLVQPGGSLRLSCAASGFTFSGYAMSWVRQAPGKGLEWVAYISNSGGNAHYADSVKGRFTISRDNSKNTLYLQMNSLRAEDTAVYYCTREDYGTSPFVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2049 - protein, 448 aa, Artificial Sequence
  chemically synthesized
EVQLVESGGGLVQPGGSLRLSCAASGFTFSGYAMSWVRQAPGKGLEWVAYISNSGGNAHYADSVKGRFTISRDNSKNTLYLQMNSLRAEDTAVYYCTREDYGTSPFVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2050 - protein, 448 aa, Artificial Sequence
  chemically synthesized
EVQLVESGGGLVQPGGSLRLSCAASGFTFSGYAMSWVRQAPGKGLEWVAYISNSGGNAHYADSVKGRFTISRDNSKNTLYLQMNSLRAEDTAVYYCTREDYGTSPFVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYQSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2051 - protein, 445 aa, Artificial Sequence
  chemically synthesized
EVQLVESGGGLVQPGGSLRLSCAASGFTFSGYAMSWVRQAPGKGLEWVAYISNSGGNAHYADSVKGRFTISRDNSKNTLYLQMNSLRAEDTAVYYCTREDYGTSPFVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 2052 - protein, 446 aa, Artificial Sequence; identical to SEQ ID NO: 2047
  chemically synthesized

SEQ ID NO: 2053 - protein, 445 aa, Artificial Sequence; identical to SEQ ID NO: 2051
  chemically synthesized

SEQ ID NO: 2054 - protein, 265 aa, Artificial Sequence
  chemically synthesized
QGQSGQGTSYCSIEHYPCNTHHGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2055 - protein, 258 aa, Artificial Sequence
  chemically synthesized
TSYCSIEHYPCNTHHGGGSSGGSISSGLLSGRSDNHGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2056 - protein, 265 aa, Artificial Sequence
  chemically synthesized
QGQSGQGTSYCSIEHYPCNTHHGGGSSGGSISSGLLSGRSDNPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2057 - protein, 258 aa, Artificial Sequence
  chemically synthesized
TSYCSIEHYPCNTHHGGGSSGGSISSGLLSGRSDNPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2058 - protein, 265 aa, Artificial Sequence
  chemically synthesized
QGQSGQGTSYCSIEHYPCNTHHGGGSSGGSISSGLLSGRSANPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2059 - protein, 258 aa, Artificial Sequence
  chemically synthesized
TSYCSIEHYPCNTHHGGGSSGGSISSGLLSGRSANPGGGSDIQLTQSPSSLSASVGDRVTITCRASESVDAYGISFMNWFQQKPGKAPKLLIYAASNQGSGVPSRFSGSGSGTDFTLTISSMQPEDFATYYCQQSKDVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2060 - protein, 13 aa, Artificial Sequence
  chemically synthesized
AASGFTFSSYAMS

SEQ ID NO: 2061 - DNA, 741 bp, Artificial Sequence
  chemically synthesized
catccggcgtctaaggatactttgggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

SEQ ID NO: 2062 - DNA, 741 bp, Artificial Sequence
  chemically synthesized
catccgcagtctaaggatactttgggaggtggctcgagcggcggctctatctcttccggactgctgtccggcagatccgacaatcacggcggaggctcttacgagctgacccagcctcctagcgcctccgtgaatgtgggcgagacagtgaagatcacctgtagcggcgaccagctgcccaagtacttcgccgactggttccaccagcggagcgaccagacaatcctgcaagtgatctacgacgacaacaagcggcccagcggcatccccgagagaatcagcggaagcagcagcggcaccaccgccaccctgaccattagagatgtgcgggccgaggacgagggcgactactactgctttagcggctacgtggacagcgacagcaagctgtacgtgttcggctccggtacccagctgacagtgctgggcggacctaagagcagccccaaagtgaccgtgttccccccaagccccgaggaactgaggaccaacaaggccaccctcgtgtgcctcgtgaacgacttctaccctggcagcgccaccgtgacctggaaagccaatggcgccaccatcaacgacggcgtgaaaaccaccaagcccagcaagcagggccagaactacatgaccagcagctacctgagcctgaccgccgaccagtggaagtcccacaacagagtgtcctgccaagtgacccacgagggggaaaccgtggaaaagagcctgagccctgccgagtgcctg

What is claimed:

1. An isolated antibody or antigen binding fragment thereof (AB) that specifically binds to a human PD-1, wherein the AB comprises:
   a VH CDR1 amino acid sequence comprising GFTFSGYAMS (SEQ ID NO: 653),
   a VH CDR2 amino acid sequence comprising YISNSGGNAH (SEQ ID NO: 658),
   a VH CDR3 amino acid sequence comprising EDYGTSPFVY (SEQ ID NO: 664),
   a VL CDR1 amino acid sequence comprising an amino acid sequence selected from the group consisting of RASESVDSYGISFMN (SEQ ID NO: 675), and RASESVDAYGISFMN (SEQ ID NO: 676)
   a VL CDR2 amino acid sequence comprising AASNQGS (SEQ ID NO: 678),
   a VL CDR3 amino acid sequence comprising QQSKDVPWT (SEQ ID NO: 683).

2. An activatable antibody that, when activated, specifically binds to a human PD-1, wherein said activatable antibody comprises:
   an antibody or an antigen binding fragment thereof (AB) that specifically binds to mammalian PD-1, wherein the AB comprises
      a VH CDR1 amino acid sequence comprising GFTFSGYAMS (SEQ ID NO: 653),
      a VH CDR2 amino acid sequence comprising YISNSGGNAH (SEQ ID NO: 658),
      a VH CDR3 amino acid sequence comprising EDYGTSPFVY (SEQ ID NO: 664),
      a VL CDR1 amino acid sequence comprising an amino acid sequence selected from the group consisting of RASESVDSYGISFMN (SEQ ID NO: 675), and RASESVDAYGISFMN (SEQ ID NO: 676)
      a VL CDR2 sequence comprising AASNQGS (SEQ ID NO: 678),
      a VL CDR3 sequence comprising QQSKDVPWT (SEQ ID NO: 683);
   a masking moiety (MM) that inhibits the binding of the AB to mammalian PD-1 when the activatable antibody is in an uncleaved state; and
   a cleavable moiety (CM) coupled to the AB, wherein the CM is a polypeptide that functions as a substrate for a protease,
   wherein the MM is coupled to the AB via the CM.

3. The activatable antibody of claim 2, wherein the AB specifically blocks a human PD-L1 and a human PD-L2 from binding to the human PD-1.

4. The activatable antibody of claim 2, wherein the activatable antibody in an uncleaved state specifically binds to the human PD-1 with a dissociation constant of 0.5 nM to 1 nM.

5. The activatable antibody of claim 2, wherein the MM has one or more of the characteristics selected from the group consisting of:
   (a) the MM has a dissociation constant for binding to the AB that is greater than the dissociation constant of the AB to PD-1;
   (b) the MM does not interfere or compete with the AB for binding to PD-1 when the activatable antibody is in a cleaved state;
   (c) the MM is a polypeptide of no more than 40 amino acids in length; and
   (d) the MM polypeptide sequence is different from that of human PD-1.

6. The activatable antibody of claim 2, wherein the CM is a substrate for a protease that is active in diseased tissue.

7. The activatable antibody of claim 2, wherein the AB has one or more of the characteristics selected from the group consisting of:
   (a) the AB is an antigen binding fragment selected from the group consisting of a Fab fragment, a F(ab')$_2$ fragment, a scFv, a scAb, a dAb, a single domain heavy chain antibody, and a single domain light chain antibody;
   (b) the AB is a monoclonal antibody;
   (c) the AB is linked to the CM;
   (d) the AB is linked directly to the CM; and
   (e) the AB is linked to the CM via a linking peptide.

8. The activatable antibody of claim 2, wherein the MM is linked to the CM such that the activatable antibody in an uncleaved state comprises the structural arrangement from N-terminus to C-terminus as follows: MM-CM-AB or AB-CM-MM.

9. The activatable antibody of claim 8, wherein the activatable antibody comprises a linking peptide between the MM and the CM, wherein the activatable antibody comprises a linking peptide between the CM and the AB, or wherein the activatable antibody comprises a linking peptide between the MM and the CM and a linking peptide between the CM and the AB.

10. The activatable antibody of claim 8, wherein the activatable antibody comprises a first linking peptide (LP1) and a second linking peptide (LP2), and wherein the activatable antibody in the uncleaved state has the structural arrangement from N-terminus to C-terminus as follows: MM-LP1-CM-LP2-AB or AB-LP2-CM-LP1-MM.

11. The activatable antibody of claim 10, wherein LP1 and LP2 have one or more of the characteristics selected from the group consisting of:
   (a) the two linking peptides need not be identical to each other; and
   (b) each of LP1 and LP2 is a peptide of about 1 to 20 amino acids in length.

12. A conjugated activatable antibody comprising the activatable antibody of claim 2 conjugated to an agent.

13. The conjugated activatable antibody of claim 12, wherein the agent has one or more of the following characteristics selected from the group consisting of:
   (a) the agent is conjugated to the activatable antibody via a linker;
   (b) the agent is conjugated to the activatable antibody via a cleavable linker,
   (c) the linker is conjugated to the activatable antibody via a non-cleavable linker;
   (d) the agent is a detectable moiety; and
   (e) the agent is a diagnostic agent.

14. A pharmaceutical composition comprising the conjugated activatable antibody of claim 12 and a carrier.

15. A pharmaceutical composition comprising the activatable antibody of claim 2 and a carrier.

16. The pharmaceutical composition of claim 14 comprising an additional agent.

17. The pharmaceutical composition of claim 15 comprising an additional agent.

18. The pharmaceutical composition of claim 16, wherein the additional agent is a therapeutic agent.

19. The pharmaceutical composition of claim 17, wherein the additional agent is a therapeutic agent.

20. An isolated nucleic acid molecule encoding the activatable antibody of claim 2.

21. A vector comprising the isolated nucleic acid molecule of claim 20.

22. A method of producing an activatable antibody by culturing a cell under conditions that lead to expression of the activatable antibody, wherein the cell comprises the nucleic acid molecule of claim 20.

23. A method of manufacturing an activatable antibody that, when activated, binds to PD-1, the method comprising:
   (a) culturing a cell comprising a nucleic acid construct that encodes the activatable antibody of claim 2 under conditions that lead to expression of the activatable antibody; and
   (b) recovering the activatable antibody.

24. A method of reducing binding of a ligand selected from the group consisting of PD-L1 or PD-L2 to PD-1 on T cells comprising administering an effective amount of the activatable antibody of claim 2 to a subject in need thereof.

25. A method of reducing immune suppression mediated by engagement of PD-1 on T cells to PD-L1 or PD-L2 on tumor or other immune cells, the method comprising administering to a subject in need thereof a therapeutically effective amount of the activatable antibody of claim 2.

26. A method of treating, alleviating a symptom of, or delaying the progression of a cancer comprising administering to a subject in need thereof a therapeutically effective amount of the activatable antibody of claim 2.

27. The method of claim 24, wherein the method further comprises administering an additional agent, wherein the additional agent is a therapeutic agent.

28. An isolated nucleic acid molecule encoding the antibody of claim 1.

29. A vector comprising the isolated nucleic acid molecule of claim 28.

30. A method of producing an antibody by culturing a cell under conditions that lead to expression of the antibody, wherein the cell comprises a nucleic acid construct that encodes the antibody of claim 1 under conditions that lead to expression of the antibody, and recovering the antibody.

31. A method of reducing immune suppression mediated by engagement of PD-1 on T cells to PD-L1 or PD-L2, comprising administering to a subject in need thereof a therapeutically effective amount of the antibody of claim 1.

32. A method of treating, alleviating a symptom of, or delaying the progression of a cancer comprising administering to a subject in need thereof a therapeutically effective amount of the antibody of claim 1.

33. The method of claim 32, wherein the method further comprises administering an additional agent, wherein the additional agent is a therapeutic agent.

34. The activatable antibody of claim 2, wherein the MM comprises an amino acid sequence selected from the group consisting of SEQ ID NOs: 66-213, 384-514, and 548-571.

35. The activatable antibody of claim 2, wherein the MM comprises an amino acid sequence selected from the group consisting of SEQ ID NOs: 66, 67, 70, 71, 74, 77, 81, 82, 84, 90, 91, 93, and 99.

36. The activatable antibody of claim 2, wherein the MM comprises the amino acid sequence of SEQ ID NO: 99.

37. The activatable antibody of claim 2, wherein the CM comprises an amino acid sequence selected from the group consisting of SEQ ID NOs: 214, 294-361, 1092-1112, 1157, 1158, 1161, 1162, 1165, 1166, 1169, 1520, and 1695-1704.

38. The activatable antibody of claim 2, wherein the CM comprises an amino acid sequence selected from the group consisting of SEQ ID NOs: 214, 294, 300, 302, 303, 305, 308, 318, 347, 361, 1092-1102, 1111, and 1157.

39. The activatable antibody of claim 2, wherein the CM comprises the amino acid sequence of SEQ ID NO: 1100.

40. The isolated antibody or antigen binding fragment thereof (AB) of claim 1, wherein the VL CDR1 sequence comprises the sequence of SEQ ID NO: 675.

41. The isolated antibody or antigen binding fragment thereof (AB) of claim 1, wherein the VL CDR1 sequence comprises the amino acid sequence of SEQ ID NO: 676.

42. The activatable antibody of claim 2, wherein the AB comprises a VL CDR1 sequence comprising the amino acid sequence of SEQ ID NO: 675.

43. The activatable antibody of claim 2, wherein the AB comprises a VL CDR1 sequence comprising the amino acid sequence of SEQ ID NO: 676.

44. The activatable antibody of claim 2, wherein the AB comprises a VH comprising the amino acid sequence of SEQ ID NO: 21 and a VL comprising the amino acid sequence of SEQ ID NO: 47.

45. The activatable antibody of claim 2, wherein the AB comprises a VH comprising the amino acid sequence of SEQ ID NO: 21 and a VL comprising the amino acid sequence of SEQ ID NO: 45.

46. The activatable antibody of claim 2, wherein the activatable antibody comprises a heavy chain that comprises an IgG4 amino acid sequence.

47. The activatable antibody of claim 46, wherein the IgG4 amino acid sequence comprises the amino acid sequence of SEQ ID NO: 383.

48. An activatable antibody comprising an antibody or antigen binding fragment thereof that specifically binds to a human PD-1, wherein the activatable antibody comprises a light chain comprising the amino acid sequence of SEQ ID NO: 2056 and a heavy chain comprising the amino acid sequence of SEQ ID NO: 2053.

49. A conjugated activatable antibody comprising the activatable antibody of claim 48 conjugated to an agent.

50. A pharmaceutical composition comprising the activatable antibody of claim 48 and a carrier.

51. An isolated nucleic acid molecule encoding the activatable antibody of claim 48.

52. A vector comprising the isolated nucleic acid molecule of claim 51.

53. A method of producing an activatable antibody, wherein the method comprises culturing a cell under conditions that lead to expression of the activatable antibody, wherein the cell comprises the nucleic acid molecule of claim 51.

54. A method of manufacturing an activatable antibody, the method comprising:
   (a) culturing a cell comprising a nucleic acid construct that encodes the activatable antibody of claim 48 under conditions that lead to expression of the activatable antibody; and
   (b) recovering the activatable antibody.

55. A method of reducing binding of a ligand selected from the group consisting of PD-L1 or PD-L2 to PD-1 on T cells comprising administering an effective amount of the activatable antibody of claim 48 to a subject in need thereof.

56. A method of reducing immune suppression mediated by engagement of PD-1 on T cells by PD-L1 or PD-L2 on tumor cells or other immune cells, the method comprising administering to a subject in need thereof a therapeutically effective amount of the activatable antibody of claim 48.

57. A method of treating, alleviating a symptom of, or delaying the progression of a cancer, comprising administering to a subject in need thereof a therapeutically effective amount of the activatable antibody of claim 48.

58. A pharmaceutical composition comprising the activatable anti-PD-1 antibody of claim 48 and an excipient.

59. The method of claim 57, wherein the method further comprises administering an additional agent that is a therapeutic agent.

60. A cell comprising the nucleic acid molecule of claim 20.

61. A cell comprising the nucleic acid molecule of claim 51.

62. An activatable antibody comprising an antibody or antigen binding fragment thereof that specifically binds to a human PD-1, wherein the activatable antibody comprises a light chain comprising the amino acid sequence of SEQ ID NO: 2057 and a heavy chain comprising the amino acid sequence of SEQ ID NO: 2053.

63. A conjugated activatable antibody comprising the activatable antibody of claim 62 conjugated to an agent.

64. A pharmaceutical composition comprising the activatable antibody of claim 62 and a carrier.

65. An isolated nucleic acid molecule encoding the activatable antibody of claim 62.

66. A vector comprising the isolated nucleic acid molecule of claim 65.

67. A cell comprising the nucleic acid molecule of claim 65.

68. A method of producing an activatable antibody, wherein the method comprises culturing a cell under conditions that lead to expression of the activatable antibody, wherein the cell comprises the nucleic acid molecule of claim 65.

69. A method of manufacturing an activatable antibody, the method comprising:
   (a) culturing a cell comprising a nucleic acid construct that encodes the activatable antibody of claim 62 under conditions that lead to expression of the activatable antibody; and
   (b) recovering the activatable antibody.

70. A method of reducing binding of a ligand selected from the group consisting of PD-L1 or PD-L2 to PD-1 on T cells comprising administering an effective amount of the activatable antibody of claim 62 to a subject in need thereof.

71. A method of reducing immune suppression mediated by engagement of PD-1 on T cells by PD-L1 or PD-L2 on tumor cells or other immune cells, the method comprising administering to a subject in need thereof a therapeutically effective amount of the activatable antibody of claim 62.

72. A method of treating, alleviating a symptom of, or delaying the progression of a cancer, comprising administering to a subject in need thereof a therapeutically effective amount of the activatable antibody of claim 62.

73. A pharmaceutical composition comprising the activatable anti-PD-1 antibody of claim 62 and an excipient.

74. The method of claim 72, wherein the method further comprises administering an additional agent that is a therapeutic agent.

75. The activatable antibody of claim 62, wherein SEQ ID NO: 2057 has a spacer sequence conjugated at its N-terminus.

76. The activatable antibody of claim 62, wherein SEQ ID NO: 2057 has a spacer sequence conjugated at its N-terminus, and where the spacer sequence comprises an unconventional amino acid.

77. The activatable antibody of claim 76, wherein the unconventional amino acid is at the N-terminus of the spacer sequence.

* * * * *